US009221902B2

(12) United States Patent
Smider et al.

(10) Patent No.: US 9,221,902 B2
(45) Date of Patent: Dec. 29, 2015

(54) COMBINATORIAL ANTIBODY LIBRARIES AND USES THEREOF

(75) Inventors: Vaughn Smider, San Diego, CA (US); James Graziano, San Diego, CA (US); Helen Hongyuan Mao, San Diego, CA (US); Byeong Doo Song, San Diego, CA (US); Tyson Chase, San Diego, CA (US); Omar Bazirgan, San Diego, CA (US)

(73) Assignee: Fabrus, Inc., San Diego, CA (US)

( * ) Notice: Subject to any disclaimer, the term of this patent is extended or adjusted under 35 U.S.C. 154(b) by 162 days.

(21) Appl. No.: 13/128,219

(22) PCT Filed: Nov. 4, 2009

(86) PCT No.: PCT/US2009/063299
§ 371 (c)(1),
(2), (4) Date: May 6, 2011

(87) PCT Pub. No.: WO2010/054007
PCT Pub. Date: May 14, 2010

(65) Prior Publication Data
US 2012/0058906 A1 Mar. 8, 2012

Related U.S. Application Data

(60) Provisional application No. 61/198,764, filed on Nov. 7, 2008, provisional application No. 61/211,204, filed on Mar. 25, 2009.

(51) Int. Cl.
| | | |
|---|---|---|
| C40B 50/08 | (2006.01) | |
| C07K 16/22 | (2006.01) | |
| C07K 16/00 | (2006.01) | |
| C07K 16/18 | (2006.01) | |
| C07K 16/28 | (2006.01) | |
| C40B 40/08 | (2006.01) | |

(52) U.S. Cl.
CPC ........... *C07K 16/22* (2013.01); *C07K 16/00* (2013.01); *C07K 16/18* (2013.01); *C07K 16/28* (2013.01); *C07K 16/2869* (2013.01); *C07K 16/2887* (2013.01); *C40B 40/08* (2013.01); *C40B 50/08* (2013.01); *C07K 2316/95* (2013.01); *C07K 2316/96* (2013.01); *C07K 2317/55* (2013.01); *C07K 2317/56* (2013.01); *C07K 2317/73* (2013.01); *C07K 2317/74* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | | |
|---|---|---|---|
| 4,751,180 A | 6/1988 | Cousens et al. | |
| 4,935,233 A | 6/1990 | Bell et al. | |
| 5,605,793 A | 2/1997 | Stemmer et al. | |
| 5,643,768 A | 7/1997 | Kawasaki et al. | |
| 5,658,754 A | 8/1997 | Kawasaki et al. | |
| 5,811,238 A | 9/1998 | Stemmer et al. | |
| 5,830,721 A | 11/1998 | Stemmer et al. | |
| 5,965,408 A | 10/1999 | Short et al. | |
| 6,177,263 B1 | 1/2001 | Arnold et al. | |
| 6,562,594 B1 | 5/2003 | Short et al. | |
| 6,593,081 B1 | 7/2003 | Griffiths et al. | |
| 6,989,250 B2 | 1/2006 | Soderlind et al. | |
| 2002/0102613 A1 | 8/2002 | Hoogenboom et al. | |
| 2003/0022240 A1 | 1/2003 | Luo et al. | |
| 2003/0036092 A1 | 2/2003 | Iverson et al. | |
| 2003/0100023 A1 | 5/2003 | Iverson et al. | |
| 2003/0153038 A1 | 8/2003 | Ohlin et al. | |
| 2004/0005709 A1 | 1/2004 | Hoogenboom et al. | |
| 2004/0253242 A1* | 12/2004 | Bowdish et al. | 424/145.1 |
| 2005/0079574 A1 | 4/2005 | Bond et al. | |
| 2005/0119455 A1 | 6/2005 | Fuh et al. | |
| 2006/0115874 A1 | 6/2006 | Garrard et al. | |
| 2006/0234302 A1 | 10/2006 | Hoet et al. | |

FOREIGN PATENT DOCUMENTS

| | | |
|---|---|---|
| EP | 0368684 | 11/1988 |
| EP | 89311731 | 11/1989 |
| JP | 2006518585 | 8/2006 |
| WO | WO 92/01047 | 1/1992 |
| WO | WO 95/22625 | 8/1995 |
| WO | WO 97/08320 | 3/1997 |
| WO | WO 97/20078 | 6/1997 |
| WO | WO 98/37186 | 8/1998 |
| WO | WO 00/09560 | 2/2000 |
| WO | WO 02/38756 | 5/2002 |
| WO | WO 2004/050017 | 6/2004 |

(Continued)

OTHER PUBLICATIONS

Hoogenboom and Winter (1992) By-passing immunisation: Human antibodies from synthetic repertoires of germline VH gene segments rearranged in vitro. J. Mol. Biol. 227(2):381-8.*
Bertone et al. (2005) "Advances in functional protein microarray technology" FEBS Journal, 272(21):5400-5411; published online Oct. 21, 2005.*
Akamatsu et al., "Construction of a Human Ig Combinatorial Library from Genomic V Segments and Synthetic CDR3 Fragments," J. Immunol., 151:4651-4659 (1993).
Arkin and Youvan, "An algorithm for protein engineering: Simulations of recursive ensemble mutagenesis," Proc. Natl. Acad. Sci., 89:7811-7815 (1992).
Barbas et al., "Semisynthetic combinatorial antibody libraries: A chemical solution to the diversity problem," Proc. Natl. Acad. Sci. U.S.A., 89:4457-4461 (1992).

(Continued)

*Primary Examiner* — Tracy Vivlemore
*Assistant Examiner* — Karen S Weiler
(74) *Attorney, Agent, or Firm* — Jones Day

(57) ABSTRACT

Methods for making a combinatorial antibody library from human germline segments are provided. Also provided are libraries of nucleic acid molecules compiled from germline segments encoding VL chains and libraries of nucleic acid molecules encoding VH chains, and resulting antibody libraries. The libraries are provided as addressable libraries. Methods for screening antibody libraries against a target protein antigen, and the identified or selected antibodies are provided.

2 Claims, 21 Drawing Sheets

(56) References Cited

FOREIGN PATENT DOCUMENTS

| WO | WO 2005/023993 | 3/2005 |
|---|---|---|
| WO | WO 2007/054816 | 5/2007 |
| WO | WO 2007/137616 | 12/2007 |

OTHER PUBLICATIONS

Barbas et al., "In vitro evolution of a neutralizing human antibody to human immunodeficiency virus type 1 to enhance affinity and broaden strain cross-ractivity," Proc. Natl. Acad. Sci. USA, 91:3809-3813 (1994).

Behar, I., "Design of synthetic antibody libraries," Expert Opin. Biol. Ther., 7:763-779 (2007).

Burton et al., "A large array of human monoclonal antibodies to type 1 human immunodeficiency virus from combinatorial libraries of asymptomatic seropositive individuals," Proc. Natl. Acad. Sci. U.S.A., 88:10134-10137 (1991).

Caldwell and Joyce, "Rnadomization of Genes by PCR Mutageneis," Methods Appl., 2:28-33 (1992).

Clackson et al., "Makin antibody fragments using phage display libraries," Nature, 352:624 (1991).

Coco et al., "DNA shuffling method for generating highly recombined genes and evolved enzymes," Nature Biotech., 19:354 (2001).

Collet et al., "A binary plasmid system for shuffling combinatorial antibody libraries," Proc. Natl. Acad. Sci. USA, 89:10026-10030 (1992).

Crameri et al., "DNA shuffling of a family of genes from diverse species accelerates directed evolution," Nature, 391:288-291 (1998).

Ewert et al., "Structure-Based Improvement of the Biophysical Properties of Immunoglobulin Vh Domains with a Generalizable Approach,"Biochemistry, 42(6):1517-1528 (2003).

Dewildt et al., "Antibody arrays for high-throughput screening of antibody-antigen interactions," Nature Biotechnology, 18:989-994 (2000).

Ewert et al., "Stability improvement of antibodies for extracellular and intracellular applications: CDR grafting to stable frameworks and structure-based framework engineering," Methods, 23(2):184-199 (2004).

Fellouse, "Synthetic antibodies from a four-amino-acid code: A dominant role for tyrosine in antigen recognition," PNAS, 101:12467-12472 (2004).

Francisco et al., "Production and fluorescence-activated cell sorting of Escherichia coli expressing a functional antibody fragment on the external surface," Proc. Natl. Acad. Sci., USA, 90:10444-10448 (1993).

Gram et al., "In vitro selection and affinity maturation of antibodies from a naive combinatorial immunoglobulin library," Proc. Natl. Acad. Sci., 89:3576-3580 (1992).

Greener et al., "An Efficient Random Mutagenesis Technique Using an E. coli Mutator Strain," Mol. Biotechnol., 7:189-195 (1997).

Griffiths et al., "Isolation of high affinity human antibodies directly from large synthetic epertoires," EMBO J., 13:3245-3260 (1994).

Hawkins et al., "Selection of Phage Antibodies by Binding Affinity Mimicking Affinity Maturation," J. Mol. Biol., 226(3):889-896 (1992).

Hermes et al., "Searching sequence space by definably random mutagenesis: Improving the catalytic potency of an enzyme," Proc. Natl. Acad. Sci., 87:696-700 (1990).

Ho et al., "In vitro antibody evolution targeting germline hot spots to increase activity of an anti-CD22 immunotoxin," J. Biol. Chem., 280:607-617 (2005).

Hoogenboom et al., "By-passing Immunisation," J. Mol. Biol., 227:381-388 (1992).

Huse et al., "Generation of a Large Combinatorial Library of the Immunoglobulin Repertoire in Phge Lambda," Science, 246:1275-1281 (1989).

Huston et al., "Protein engineering of antibody binding sites: recovery of specific activity in an anti-digoxin single-chain Fv analogue produced in Escherichia coli," PNAS, 85:5879-5883 (1988).

Kang et al., "Antibody redesign by chain shuffling from random combinatorial immunoglobulin libraries," Proc. Natl. Acad. Sci. USA, 88:11120-11123 (1991).

Kieke et al., "Isolation of anti-T cell receptor scFv mutants by yeast surface display," Prot.Eng., 10:1303-1310 (1997).

Kim et al., "Antibody Engineering for the Development of Therapeutic Antibodies," Mol. Cells, 20:17-29 (2005).

Knappik et al., "Fully synthetic human combinatorial antibody libraries based on modular consensus frameworks and CDRs Randomized with Trinucleotides," J. Mol. Biol., 296:57-86 (2000).

Knappik et al., "Engineered turns of a recombinant antibody improve its in vivo folding," Protein Engineering, 8:81-89 (1995).

Leung et al., "A method for random mutagenesis of a defined DNA segment using a modified polymerase chain reaction," Technique, 1:11-15 (1989).

Low et al., "Mimicking Somatic Hypermutation: Affinity Maturation of Antibodies Displayed on Bacteriophage Using a Bacterial Mutator Strain," J. Mol. Biol. 260:359 (1996).

Marks et al., "By-Passing Immunization: Building High Affinity Human Antibodies by Chain Shuffling," Bio/Technology, 10:779 (1992).

Marks et al., "By-passing Immunization: Human Antibodies from V-gene Libraries Displayed on Phage," J. Mol. Biol., 222:581-597 (1991).

Mondon et al., "Human antibody libraries: a race to engineer and explore a larger diversity," Frontiers in Bioscience, 13:1117-1129 (2008).

Newton et al., "Angiogenin Single-Chain Immunofusions: Influence of Peptide Linkers and Spacers between Fusion Protein Domains," Biochemistry, 35:545-553 (1996).

Nissim et al, "Antibody fragments from a 'single pot' phage display library as immunochemical reagents," EMBO J., 13:692-698 (1994).

Odegrip et al., "CIS display: In vitro selection of peptides from libraries of protein-DNA complexes," Proc. Natl. Acad. Sci., U.S.A., 101:2806-2810 (2004).

Oliphant et al., "Cloning of random-sequence oligodeoxynucleotides," Gene, 44:177-183 (1986).

Orlandi et al., "Cloning immunoglobulin variable domains for expression by the polymerase chain reaction," Proc. Natl. Acad. Sci. U.S.A., 86:3833-3837 (1989).

Ostermeier et al., "A combinatorial approach to hybrid enzymes independent of DNA homology," Nat. Biotechnol., 17:1205-1209 (1999).

Persson et al., "A focused antibody library for improved hapten recognition," J. Mol. Biol., 357:607-620 (2006).

Rauchenberger et al., "Human Combinatorial Fab Library Yielding Specific and Functional Antibodies Against the Human Fibroblast Growth Factor Receptor 3," Journal of Biological Chemistry, 278(40):38194-38205 (2003).

Reidhaar-Olson, "Random Mutagenesis of Protein Sequences Usisng Oligonucleotide Cassettes," Methods Enzymol., 208:564-586 (1991).

Reiersen et al., "Covalent antibody display-an in vitro antibody-DNA library selection system," Nucl. Acids Res., 33:e10 (2005).

Roberts et al., "RNA-peptide fusions for the in vitro selection of peptides and proteins," Proc. Natl. Sci., U.S.A., 64:12297-12302 (1997).

Rosok et al., "A combinatorial library strategy for the rapid humanization of anticarcinoma BR96 Fab," J. Biol. Chem., 271:22611-22618 (1996).

Rothe et al., "The Human Combinatorial Antibody Library HuCAL Gold Combines Diversification of All Six CDRs According to the Natural Immune System with a Novel Display Method for Efficient Selection of High-Affinity Antibodies," J. Mol. Biol., 376:1182-1200 (2008).

Schofield et al., "Application of phage display to high throughput antibody generation and characterization," Genome Biology, 8:R254 (2007).

Smith, G.P., "Filamentous Fusion Phage: Novel Expression Vectors That Display Cloned Antigens on the Virion Surface," Science, 228:1315-1317 (1985).

(56) References Cited

OTHER PUBLICATIONS

Stemmer and Morris, "Enzymatic inverse PCR: A restriction site independent, single, fragment method for high efficiency, site directed mutagenesis," Biotechniques, 13:214-220 (1992).

Stemmer, Rapid evolution of a protein in vitro by DNA shuffling, Nature, 370:389-391 (1994).

Stemmer, "DNA shuffling by random fragmentation and reassembly: in vitro recombination for molecular evolution," Proc. Natl. Acad. Sci. USA, 91:10747-10751 (1994).

Swers et al., "Shuffled antibody libraries created by *in vivo* homologous recombination and yeast surface display," Nucleic Acids Res., 32:e36 (2004).

Wang and Hoover, "Alterations within the Activiation Domain of the $\sigma^{54}$-Dependent Activator DctD That Prevent Transcriptional Activation," J. Bacteriol., 179:5812-5819 (1997).

Ward et al., "Binding activities of a repertoire of single immunoglobulin variable domains secreted from *Escherichia coli*," Nature, 341:544-546 (1989).

Weaver-Feldhaus et al., "Yeast mating for combinatorial Fab library generation and surface display," FEBS Lett., 564:24-34 (2004).

Whitlow et al., "An improved linker for single-chain Fv with reduced aggregation and enhanced proteolytic stability," Protein Engineering, 6:989-995 (1993).

Winters et al., "Making Antibodies by Phage Display Technology," Annu Rev. Immunol., 12:433-455 (1994).

Yang et al., "CDR Walking Mutagenesis for the Affinity Maturation of a Potent Human Anti-HIV-1 Antibody into the Picomolar Range," J. Mol. Biol., 254(3):392-403 (1995).

Zoller et al., "Oligonucleotide-directed mutagenesis using M13-derived vectors: an efficient and general procedure for the production of point mutations in any fragment of DNA," Nucl. Acids Res., 10:6487-6504 (1987).

\* cited by examiner

V(D)J SEQUENCES FILE FORMAT
```
//*************************************************************
//
// V, D, J Sequences
//
// IMPORTANT: a blank line must be present between two sequences
//
//*************************************************************
[VH]
>VH1-18
CAGGTTCAGCTGGTGCAGTCTGGAGCTGAGGTGAAGAAGCCTGGGGCCTCAGTGAAGGTC
TCCTGCAAGGCTTCTGGTTACACCTTTACCAGCTATGGTATCAGCTGGGTGCGACAGGCC
CCTGGACAAGGGCTTGAGTGGATGGGATGGATCAGCGCTTACAATGGTAACACAAACTAT
GCACAGAAGCTCCAGGGCAGAGTCACCATGACCACAGACACATCCACGAGCACAGCCTAC
ATGGAGCTGAGGAGCCTGAGATCTGACGACACGGCCGTGTATTACTGTGCGAGAGA
>VH1-2
CAGGTGCAGCTGGTGCAGTCTGGGGCTGAGGTGAAGAAGCCTGGGGCCTCAGTGAAGGTC
TCCTGCAAGGCTTCTGGATACACCTTCACCGGCTACTATATGCACTGGGTGCGACAGGCC
CCTGGACAAGGGCTTGAGTGGATGGGATGGATCAACCCTAACAGTGGTGGCACAAACTAT
GCACAGAAGTTTCAGGGCAGGGTCACCATGACCAGGGACACGTCCATCAGCACAGCCTAC
ATGGAGCTGAGCAGGCTGAGATCTGACGACACGGCCGTGTATTACTGTGCGAGAGA
//*************************************************************
// Heavy Chain D sequences
//*************************************************************
[DH]
>IGHD1-1*01
GGTACAACTGGAACGAC
//*************************************************************
// Heavy Chain J sequences
//*************************************************************
[JH]
>IGHJ1*01
GCT GAA TAC TTC CAG CAC TGG GGC CAG GGC ACC CTG GTC ACC GTC TCC TCA G
//*************************************************************
// Light Chain Vk sequences
//*************************************************************
[VK]
>A1
GATGTTGTGATGACTCAGTCTCCACTCTCCCTGCCCGTCACCCTTGGACAGCCGGCCTCC
ATCTCCTGCAGGTCTAGTCAAAGCCTCGTATACAGTGATGGAAACACCTACTTGAATTGG
TTTCAGCAGAGGCCAGGCCAATCTCCAAGGCGCCTAATTTATAAGGTTTCTAACTGGGAC
TCTGGGGTCCCAGACAGATTCAGCGGCAGTGGGTCAGGCACTGATTTCACACTGAAAATC
AGCAGGGTGGAGGCTGAGGATGTTGGGGTTTATTACTGCATGCAAGGTACACACTGGCCT
CC
>A10
GAAATTGTGCTGACTCAGTCTCCAGACTTTCAGTCTGTGACTCCAAAGGAGAAAGTCACC
ATCACCTGCCGGGCCAGTCAGAGCATTGGTAGTAGCTTACACTGGTACCAGCAGAAACCA
GATCAGTCTCCAAAGCTCCTCATCAAGTATGCTTCCCAGTCCTTCTCAGGGGTCCCCTCG
AGGTTCAGTGGCAGTGGATCTGGGACAGATTTCACCCTCACCATCAATAGCCTGGAAGCT
GAAGATGCTGCAACGTATTACTGTCATCAGAGTAGTAGTTTTACCTCA
//*************************************************************
// Light Chain Jk sequences
//*************************************************************
[JK]
>IGKJ1*01
G TGG ACG TTC GGC CAA GGG ACC AAG GTG GAA ATC AAA C
//*************************************************************
// Light Chain VL sequences
//*************************************************************
[VL]
>V1-11
CAGTCTGTGCTGACGCAGCCGCCCTCGGTGTCTGAAGCCCCCAGGCAGAGGGTCACCATC
TCCTGTTCTGGAAGCAGCTCCAACATCGGAAATAATGCTGTAAACTGGTACCAGCAGCTC
CCAGGAAAGGCTCCCAAACTCCTCATCTATTATGATCTGCTGCCCTCAGGGGTCTCT
GACCGATTCTCTGGCTCCAAGTCTGGCACCTCAGCCTCCCTGGCCATCAGTGGGCTCCAG
TCTGAGGATGAGGCTGATTATTACTGTGCAGCATGGGATGACAGCCTGAATGGTCC
>V1-13
CAGTCTGTGCTGACGCAGCCGCCCTCAGTGTCTGGGGCCCCAGGGCAGAGGGTCACCATC
TCCTGCACTGGGAGCAGCTCCAACATCGGGGCAGGTTATGATGTACACTGGTACCAGCAG
CTTCCAGGAACAGCCCCCAAACTCCTCATCTATTGGTAACAGCAATCGGCCCTCAGGGGTC
CCTGACCGATTCTCTGGCTCCAAGTCTGGCACCTCAGCCTCCCTGGCCATCACTGGGCTC
CAGGCTGAGGATGAGGCTGATTATTACTGCCAGTCCTATGACAGCAGCCTGAGTGGTTC
//*************************************************************
// Light Chain JL sequences
//*************************************************************
[JL]
>IGLJ1*01
T TAT GTC TTC GGA ACT GGG ACC AAG GTC ACC GTC CTA G
>IGLJ2*01
T GTG GTA TTC GGC GGA GGG ACC AAG CTG ACC GTC CTA G
//*************************************************************
// Restriction Sites
//*************************************************************
[Restriction Sites]
>Mfe I
CAATTG
```

DNA Sequence Compilation

File  Well Plate  Help

Manual Compil...
- Heavy Chain
- Light Chain

Auto Compilati...
- Heavy Chain
- Light Chain

Well Plate
- 96 Well Plate

| | Selected | Rank | Outer | Diversity Score | V Sequence | D Sequence | J Sequence | Amino Acid Sequence |
|---|---|---|---|---|---|---|---|---|
| 0089 | ☐ | 13 | 50 | 89.624 | VH2-5 | IGHD3-9*01 | IGHJ6*01 | QITLKESGPTLVKPTQTLTLTCTFSGFSL... |
| 0090 | ☐ | 2640 | 58 | 89.625 | VH4-39 | IGHD1-14*01 | IGHJ6*01 | QLQLQESGPGLVKPSETLSLTCTVSGGS... |
| 0091 | ☐ | 162 | 48 | 89.676 | VH6-1 | IGHD6-19*01 | IGHJ6*01 | QVQLQQSGPGLVKPSQTLSLTCAISGDS... |
| 0092 | ☐ | 1903 | 1 | 89.677 | VH4-31 | IGHD3-16*01 | IGHJ2*01 | QVQLQESGPGLVKPSQTLSLTCTVSGG... |
| 0093 | ☐ | 465 | 116 | 89.707 | VH4-31 | IGHD2-8*01 | IGHJ6*01 | QVQLQESGPGLVKPSQTLSLTCTVSGG... |
| 0094 | ☐ | 14 | 150 | 89.829 | VH7-81 | IGHD2-21*01 | IGHJ6*01 | QVQLVQSGHEVKQPGASVKVSCKASGY... |
| 0095 | ☐ | 2814 | 38 | 89.837 | VH4-61 | IGHD3-9*01 | IGHJ6*01 | QVQLQESGPGLVKPSETLSLTCTVSGG... |
| 0096 | ☐ | 2019 | 1 | 89.838 | VH4-31 | IGHD3-22*01 | IGHJ3*01 | QVQLQESGPGLVKPSQTLSLTCTVSGG... |
| 0097 | ☐ | 163 | 50 | 89.859 | VH2-5 | IGHD6-19*01 | IGHJ6*01 | QITLKESGPTLVKPIQTLTLTCTFSGFSL... |
| 0098 | ☐ | 2134 | 1 | 89.873 | VH4-31 | IGHD7-27*01 | IGHJ2*01 | QVQLQESGPGLVKPSQTLSLTCTVSGG... |
| 0099 | ☐ | 2249 | 1 | 89.901 | VH4-61 | IGHD6-6*01 | IGHJ1*01 | QVQLQESGPGLVKPSETLSLTCTVSGG... |
| 0100 | ☐ | 2354 | 1 | 90.059 | VH4-61 | IGHD5-12*01 | IGHJ4*01 | QVQLQESGPGLVKPSETLSLTCTVSGG... |
| 0101 | ☐ | 2850 | 38 | 90.208 | VH4-61 | IGHD6-19*01 | IGHJ6*01 | QVQLQESGPGLVKPSETLSLTCTVSGG... |
| 0102 | ☐ | 1440 | 15 | 90.236 | VH4-39 | IGHD7-27*01 | IGHJ2*01 | QLQLQESGPGLVKPSETLSLTCTVSGG... |
| 0103 | ☑ | 1556 | 15 | 90.372 | VH4-39 | IGHD3-10*01 | IGHJ5*01 | QL QLQESGPGLVKPSETLSLTCTV... |
| 0104 | ☑ | 1672 | 15 | 90.473 | VH4-39 | IGHD3-16*01 | IGHJ1*01 | QL QLQESGPGLVKPSETLSLTCTV... |
| 0105 | ☑ | 1788 | 15 | 90.567 | VH4-39 | IGHD3-16*01 | IGHJ5*01 | QL QLQESGPGLVKPSETLSLTCTV... |
| 0106 | ☑ | 2479 | 1 | 90.648 | VH4-31 | IGHD3-10*01 | IGHJ5*01 | QVQLQESGPGLVKPSQTLSLTCTV... |
| ▶0107 | ☑ | 2560 | 1 | 90.650 | VH4-31 | IGHD1-26*01 | IGHJ2*01 | QVQLQESGPGLVKPSQTLSLTCTV... |
| 0108 | ☐ | 2641 | 1 | 90.672 | VH4-31 | IGHD3-16*01 | IGHJ1*01 | QVQLQESGPGLVKPSQTLSLTCTVSGG... |
| 0109 | ☐ | 2721 | 1 | 90.698 | VH4-31 | IGHD7-27*01 | IGHJ5*01 | QVQLQESGPGLVKPSQTLSLTCTVSGG... |
| 0110 | ☐ | 1904 | 1 | 90.707 | VH4-39 | IGHD3-3*01 | IGHJ2*01 | QLQLQESGPGLVKPSQTLSLTCTVSGG... |
| 0111 | ☐ | 2763 | 1 | 90.735 | VH4-4 | IGHD5-18*01 | IGHJ4*01 | QVQLQESGPGLVKPSETLSLTCTVSGG... |
| 0112 | ☐ | 2815 | 1 | 90.736 | VH4-4 | IGHD5-5*01 | IGHJ4*01 | QVQLQESGPGLVKPSETLSLTCTVSGG... |
| 0113 | ☐ | 2861 | 1 | 90.771 | VH4-31 | IGHD3-16*01 | IGHJ5*01 | QVQLQESGPGLVKPSETLSLTCTVSGG... |
| 0114 | ☐ | 2906 | 1 | 90.779 | VH4-31 | IGHD7-27*01 | IGHJ1*01 | QVQLQESGPGLVKPSQTLSLTCTVSGG... |
| 0115 | ☐ | 2020 | 15 | 90.870 | VH4-39 | IGHD1-26*01 | IGHJ2*01 | QLQLQESGPGLVKPSQTLSLTCTVSGG... |
| 0116 | ☐ | 2952 | 1 | 90.904 | VH4-31 | IGHD3-3*01 | IGHJ2*01 | QVQLQESGPGLVKPSQTLSLTCTVSGG... |
| 0117 | ☐ | 2135 | 1 | 91.100 | VH4-39 | IGHD7-27*01 | IGHJ5*01 | QLQLQESGPGLVKPSQTLSLTCTVSGG... |
| 0118 | ☐ | 2998 | 1 | 91.147 | VH4-31 | IGHD3-3*01 | IGHJ3*01 | QLQLQESGPGLVKPSQTLSLTCTVSGG... |
| 0119 | ☐ | 2250 | 15 | 91.148 | VH4-39 | IGHD7-27*01 | IGHJ1*01 | QLQLQESGPGLVKPSETLSLTCTVSGG... |
| 0120 | ☐ | 2365 | 15 | 91.150 | VH4-39 | IGHD6-13*01 | IGHJ2*01 | QVQLQESGPGLVKPSETLSLTCTVSGG... |
| 0121 | ☐ | 3044 | 1 | 91.387 | VH4-31 | IGHD6-13*01 | IGHJ2*01 | QVQLQESGPGLVKPSQTLSLTCTVSGG... |
| 0122 | ☐ | 3090 | 1 | 91.391 | VH4-31 | IGHD1-7*01 | IGHJ2*01 | QVQLQESGPGLVKPSETLSLTCTVSGG... |
| 0123 | ☐ | 2480 | 15 | 91.506 | VH4-39 | IGHD1-7*01 | IGHJ2*01 | QLQLQESGPGLVKPSETLSLTCTVSGG... |
| 0124 | ☐ | 2561 | 15 | 91.510 | VH4-39 | IGHD7-27*01 | IGHJ3*01 | QLQLQESGPGLVKPSQTLSLTCTVSGG... |
| 0125 | ☐ | 3136 | 1 | 91.535 | VH4-31 | IGHD7-27*01 | IGHJ4*01 | QVQLQESGPGLVKPSQTLSLTCTVSGG... |

Total Sequences: 7128
VH Sequences: 44
DH Sequences: 27
JH Sequences: 6

| | Selected | Rank | Cluster | BLAST Bit Score | V Sequence | D Sequence | J Sequence | Amino Acid Sequence |
|---|---|---|---|---|---|---|---|---|
| 0995 | ☐ | 1918 | 20 | 41.2 | VH1-45 | IGHD3-16*01 | IGHJ4*01 | QMQLVQSGAEVKKTGSSVKVSCKASGYTFTYRYLHWVRQAPGQ... |
| 0996 | ☐ | 2866 | 40 | 120 | VH4-4 | IGHD2-2*01 | IGHJ5*01 | QVQLQESGPGLVKPSETLSLTCTVSGGSISSSYYWSWIRQPAGKG... |
| 0997 | ☐ | 6906 | 1 | 124 | VH4-59 | IGHD3-22*01 | IGHJ3*01 | QVQLQESGPGLVKPSETLSLTCTVSGGSISSSYYWSWIRQPPGKG... |
| 0998 | ☐ | 1571 | 110 | 121 | VH4-28 | IGHD2-8*01 | IGHJ5*01 | QVQLQESGPGLVKPSDTLSLTCAVSGYSISSNWWGWIRQPPG... |
| 0999 | ☐ | 194 | 23 | 58.9 | VH1-69 | IGHD5-12*01 | IGHJ4*01 | QVQLVQSGAEVKKPGSSVKVSCKASGGTFSSYAISWVRQAPGQG... |
| 1000 | ☐ | 195 | 66 | 63.5 | VH1-69 | IGHD6-19*01 | IGHJ6*01 | QVQLVQSGAEVKKPGSSVKVSCKASGGTFSSYAISWVRQAPGQG... |
| 1001 | ☐ | 2490 | 7 | 94 | VH2-5 | IGHD7-27*01 | IGHJ3*01 | QITLKESGPTLVKPTQTLTLTCTFSGFSLSTSGGVGVGWIRQPPGK... |
| 1002 | ☐ | 6907 | 1 | 125 | VH4-61 | IGHD1-26*01 | IGHJ5*01 | QVQLQESGPGLVKPSETLSLTCTVSGGSISSYYWSWIRQPP... |
| 1003 | ☐ | 196 | 24 | 49.7 | VH1-8 | IGHD4-17*01 | IGHJ4*01 | QVQLVQSGAEVKKPGASVKVSCKASGYTFTSYDINWVRQATGQ... |
| 1004 | ☐ | 3094 | 5 | 97.1 | VH6-1 | IGHD6-6*01 | IGHJ2*01 | QVQLQQSGPGLVKPSQTLSLTCAISGDSVSSNSAAWNWIRQSPS... |
| 1005 | ☐ | 1110 | 8 | 89.4 | VH2-70 | IGHD3-22*01 | IGHJ5*01 | QVTLRESGPALVKPTQTLTLTCTFSGFSLSTSGMCVSWIRQPPG... |
| 1006 | ☐ | 6908 | 1 | 119 | VH4-4 | IGHD1-1*01 | IGHJ4*01 | QVQLQESGPGLVKPSETLSLTCTVSGGSISSYYWSWIRQPAGKG... |
| 1007 | ☐ | 6909 | 1 | 119 | VH4-4 | IGHD1-20*01 | IGHJ4*01 | QVQLQESGPGLVKPSETLSLTCTVSGGSISSYYWSWIRQPAGKG... |
| 1008 | ☐ | 3140 | 5 | 97.4 | VH6-1 | IGHD5-18*01 | IGHJ2*01 | QVQLQQSGPGLVKPSQTLSLTCAISGDSVSSNSAAWNWIRQSPS... |
| 1009 | ☐ | 3186 | 5 | 97.4 | VH6-1 | IGHD5-5*01 | IGHJ2*01 | QVQLQQSGPGLVKPSQTLSLTCAISGDSVSSNSAAWNWIRQSPS... |
| 1010 | ☐ | 6910 | 1 | 122 | VH4-59 | IGHD7-27*01 | IGHJ2*01 | QVQLQESGPGLVKPSETLSLTCTVSGGSISSYYWSWIRQPPGKG... |
| 1011 | ☐ | 6911 | 1 | 116 | VH4-4 | IGHD4-23*01 | IGHJ1*01 | QVQLQESGPGLVKPSETLSLTCTVSGGSISSYYWSWIRQPAGKG... |
| 1012 | ☐ | 3232 | 5 | 100 | VH6-1 | IGHD3-3*01 | IGHJ1*01 | QVQLQQSGPGLVKPSQTLSLTCAISGDSVSSNSAAWNWIRQSPS... |
| 1013 | ☐ | 3278 | 5 | 97.8 | VH6-1 | IGHD1-1*01 | IGHJ2*01 | QVQLQQSGPGLVKPSQTLSLTCAISGDSVSSNSAAWNWIRQSPS... |
| 1014 | ☐ | 3324 | 5 | 97.8 | VH6-1 | IGHD1-20*01 | IGHJ2*01 | QVQLQQSGPGLVKPSQTLSLTCAISGDSVSSNSAAWNWIRQSPS... |
| 1015 | ☐ | 1687 | 110 | 119 | VH4-28 | IGHD2-15*01 | IGHJ3*01 | QVQLQESGPGLVKPSDTLSLTCAVSGYSISSSNWWGWIRQPPG... |
| 1016 | ☐ | 3370 | 5 | 101 | VH6-1 | IGHD3-16*01 | IGHJ3*01 | QVQLQQSGPGLVKPSQTLSLTCAISGDSVSSNSAAWNWIRQSPS... |
| 1017 | ☐ | 6912 | 1 | 125 | VH4-61 | IGHD6-19*01 | IGHJ2*01 | QVQLQESGPGLVKPSETLSLTCTVSGGSISSYYWSWIRQPP... |
| 1018 | ☐ | 1803 | 110 | 120 | VH4-28 | IGHD2-21*01 | IGHJ3*01 | QVQLQESGPGLVKPSDTLSLTCAVSGYSISSCAVSGYSISSNWWGWIRQPPG... |

FIG. 20

COMBINATORIAL ANTIBODY LIBRARIES AND USES THEREOF

RELATED APPLICATIONS

This application is a U.S. National Stage Application under 35 U.S.C. §371 of International Patent Application No. PCT/US09/63299, filed Nov. 4, 2009, which claims the benefit of priority to U.S. Provisional Application No. 61/198,764, and to U.S. Provisional Application No. 61/211,204, filed Mar. 25, 2009, the entire contents of which are each incorporated by reference.

This application also is related to International PCT Application No. PCT/US09/63303, entitled "Anti-DLL4 Antibodies and Uses Thereof," filed Nov. 4, 2009, which claims priority to U.S. Provisional Application No. 61/198,764 and to U.S. Provisional Application No. 61/211,204. This application also is related to U.S. Provisional Application No. 61/280,618, entitled "Methods for Affinity-Maturation-Based Antibody Optimization," filed Nov. 4, 2009. Where permitted, the subject matter of each of the above-noted related applications is incorporated by reference in its entirety.

INCORPORATION BY REFERENCE OF SEQUENCE LISTING PROVIDED ELECTRONICALLY

The instant application contains a Sequence Listing that has been submitted via EFS-Web and is hereby incorporated by reference in its entirety. Said ASCII copy, created on Apr. 21, 2011, is named FAB0701US.txt, and is 3,068,750 bytes in size.

FIELD OF THE INVENTION

Methods for making a combinatorial antibody library from human germline segments are provided. Also provided are libraries of nucleic acid molecules compiled from germline segments encoding VL chains and libraries of nucleic acid molecules encoding VH chains, and resulting antibody libraries. The libraries are provided as addressable libraries. Methods for screening antibody libraries against a target protein antigen, and the identified or selected antibodies are provided.

BACKGROUND

Numerous therapeutic and diagnostic monoclonal antibodies (MAbs) are used in the clinical setting to treat and diagnose human diseases, for example, cancer and autoimmune diseases. For example, exemplary therapeutic antibodies include Rituxan (Rituximab), Herceptin (Trastuzumab), Avastin (Bevacizumab) and Remicade (Infliximab). In designing antibody therapeutics, it is desirable to create antibodies, for example, antibodies that modulate a functional activity of a target, and/or improved antibodies such as antibodies with higher specificity and/or affinity and/or and antibodies that are more bioavailable, or stable or soluble in particular cellular or tissue environments.

Available techniques for generating antibody therapeutics are limited. Current methods include using antibody libraries to select variant proteins with desired properties in vitro. The libraries are generated to contain mutational diversity by targeted and non-targeted methods (e.g., Marks et al., *J. Mol. Biol.* (1991) 222, 581-597; Winters et al. (1994) Annu Rev. Immunol. 12:433-55; Rosok et al. (1996) J. Biol. Chem., 271:22611-22618; Kim et al. (2005) Mol. Cells 20:17-29; Mondon et al. (2008) Frontiers in Bioscience, 13:1117-1129; Benhar et al. (2007) Expert Opin. Biol. Ther., 7:763-779; and Knappik et al. (2000) J. Mol. Biol., 296:57-86). Each of these antibody libraries has its limitations. Accordingly, it is among the objects herein is to provide methods for making antibody libraries, and antibodies produced by the methods.

SUMMARY

Provided herein are human combinatorial antibody libraries generated by rearrangement of human germline segments. Included among the combinatorial antibody libraries provided herein are libraries containing a plurality of antibodies, whereby each member antibody in the library contains a variable light (VL) chain and a variable heavy (VH) chain or a sufficient portion thereof to form an antigen binding site. Each VL chain of the antibodies in the library are encoded by a nucleic acid molecule that contains $V_\kappa$ and a $J_\kappa$ human germline segment or degenerate codons thereof, or a $V_\lambda$ and a $J_\lambda$ human germline segment or degenerate codons thereof, whereby the segments are linked in-frame. Each VH chain of the antibodies in the library are encoded by a nucleic acid molecule that contains a human $V_H$ and a human $J_H$ germline segment and any sequence of nucleotides between the $V_H$ and a JH germline segments, whereby the segments are linked in-frame. The human combinatorial antibody libraries contain at least about or 50 or 100 more different members. Each member in the library contains an antigen binding site and is a functional and productive antibody.

In such an example of a human combinatorial antibody library, the $V_H$ germline segment, the sequence of nucleotides between the $V_H$ and $J_H$ and the $J_H$ germline segment of the nucleic acid molecule encoding a VH chain are linked such that the $V_H$ segment is 5' to the sequence of nucleotides between the $V_H$ and $J_H$ which is 5' to the $J_H$ segment; and the $V_\kappa$ and $J_\kappa$ or $V_\lambda$ and $J_\lambda$ germline segments of the nucleic acid molecule encoding a VL chain are linked such that the $V_\kappa$ segment is 5' to the $J_\kappa$ segment or the $V_\lambda$ segment is 5' to the $J_\lambda$ segment The sequence of nucleotides between the $V_H$ and $J_H$ germline segments is at or is about 5, 10, 20, 30, 40, 50, 60, 70, 80, 90 or 100 nucleotides in length. In some examples, the sequence of nucleotides between the $V_H$ and $J_H$ germline segments encodes a peptide mimetic.

Also provided herein is a human combinatorial antibody library containing a plurality of antibodies, whereby each member antibody contains a modified variable light (VL) chain and/or a modified variable heavy chain (VH) chain or a sufficient portion thereof to form an antigen binding site. The VL chain in each library is encoded by a nucleic acid molecule that contains a $V_\kappa$ and a $J_\kappa$ human germline segment or degenerate codons thereof, or a $V_\lambda$ and a $J_\lambda$ human germline segment or degenerate codons thereof, whereby the segments are linked in-frame. Each $V_H$ chain of antibodies in the library are encoded by a nucleic acid molecule that contains a $V_H$, $D_H$ and a $J_H$ human germline segment or degenerate codons thereof, whereby the segments are linked in-frame. The resultant protein of the VL chain and the VH chain are modified by amino acid replacement or insertion of amino acids into a CDR. The CDR can be any one or more up to all of a CDRH1, CDRH2, CDRH3, CDRL1, CDRL2 or a CDRL3, for example, a CDRH3. The amino acids that can be inserted or replaced correspond to a peptide mimetic.

In all of the examples above, the peptide mimetic can be a TPO, EPO, G-CSF, IL-5, human brain natriuretic peptide (hBNP-32), exendin 4, GLP-1, GLP-2, glucagon, PACAP-38, CD209L, TNF, VEGF, MMP inhibitor, or CTLA-4 peptide mimetic. In particular of a peptide mimietic is a mimetic that mimics Epo activiation of its receptor. The peptide mimetic further can include a flanking sequence at the carboxy and/or N-terminal end, such as an amino acid or amino acids. For example, the flanking sequence can include glycine or a proline. Exemplary of peptide mimetics are any set forth in any of SEQ ID NOS: 891, and 987-1014.

In the libraries provided above, the nucleotides between the $V_H$ and $J_H$ germline segments is a human germline $D_H$ segment or degenerate codons thereof. Hence, a human combinatorial antibody library provided herein includes a library containing a plurality of antibodies, each member antibody contains a variable light (VL) chain and a variable heavy (VH) chain or a sufficient portion thereof to form an antigen binding site. Each VL chain of the antibodies in the library are encoded by a nucleic acid molecule that contains a $V_\kappa$ and a $J_\kappa$ human germline segment or degenerate codons thereof, or a $V_\lambda$ and a $J_\lambda$ human germline segment or degenerate codons thereof, whereby the segments are linked in-frame. Each VH chain of the antibodies in the library are encoded by nucleic acid molecule that contains a $V_H$, $D_H$ and a $J_H$ germline segment, whereby the segments are linked in-frame. The human combinatorial antibody library contains at least about or 50 or 100 more different members. In such examples of a human combinatorial antibody library, the $V_H$, $D_H$ and $J_H$ segments of the nucleic acid molecule encoding a VH chain are linked such that the $V_H$ segment is 5' to the $D_H$ segment which is 5' to the $J_H$ segment; and the $V_\kappa$ and $J_\kappa$ or $V_\lambda$ and $J_\lambda$ germline segments of the nucleic acid molecule encoding a VL chain are linked such that the $V_\kappa$ segment is 5' to the $J_\kappa$ segment or the $V_\lambda$ segment is 5' to the $J_\lambda$ segment.

In all of the human combinatorial antibody libraries provided herein, the libraries can be provided as addressable libraries. In such addressable libraries, the antibody within each address is the same antibody and is different from the antibodies at all other addresses. For example, the addressable antibodies in the library are arranged in a spatial array. The spatial array can be a multiwall plate, wherein each individual locus of the plate corresponds to a different antibody member. The antibody members can be immobilized to the surface of the wells of the plate or can be present in solution. In another example, the addressable antibodies are attached to a solid support. In such an example, the solid support can be a filter, chip, slide, bead or cellulose, and the different antibody members are immobilized to the surface thereof. In some examples, the solid support is a biacore chip. In any of the addressable libraries provided herein, the members can be identifiably labeled. For example, the label can be colored, chromogenic, luminescent, chemical, fluorescent or electronic.

The human combinatorial libraries provided herein include members whereby a plurality of nucleic acid molecules encode a VH chain and a plurality of nucleic acid molecules encode a VL chain such that the plurality of nucleic acid molecules encoding the VH chain and the VL chain are sufficient to generate at least about or 50 or 100 different antibodies. Hence, in the libraries provided herein, in the nucleic acid molecules encoding a VH chain all or a subset of germline VH segments are linked with all or a subset of $D_H$ segments which are linked with all or a subset of germline $J_H$ segments to generate the plurality of nucleic acid molecules encoding a VH chain; and in the nucleic acid molecules encoding a VL chain all or a subset of germline $V_\lambda$ segments are linked with all or a subset of germline $J_\lambda$ segments, or all or a subset of germline $V_\lambda$ segments are linked to all or a subset of germline $J_\lambda$ segments to generate a plurality of nucleic acid molecules encoding a VL chain.

In the libraries provided herein, the VH chains in the members in the library are encoded by rearranged nucleic acid sequences combined by joining a human $V_H$ germline segment, a $D_H$ germline segment and a $J_H$ germline segment. The human $V_H$ germline segment is an IGHV1, IGHV2, IGHV3, IGHV4, IGHV5, IGHV6 or IGHV7 and genes and alleles thereof, for example, any set forth in any of SEQ ID NOS: 10-238. In examples of the combinatorial antibody libraries provided herein, the $V_H$ gene segment can have one nucleiotide added or removed at the V-D joint of the nucleic acid molecule encoding the VH chain to maintain the reading frame of the $V_H$ chain. For example, a nucleotide is inserted at the 3' end of a $V_H$ nucleotide sequence to add a nucleotide between the $V_H$ and $D_H$. The nucleotide can be any nucleotide, in particular, the nucleotide is a guanine (G). The $D_H$ segment is an IGHD1, IGHD2, IGHD3, IGHD4, IGHD5, IGHD6, or IGHD7 and genes and alleles thereof, for example, any set forth in any of SEQ ID NOS:239-272. In the examples of the combinatorial antibody libraries provided herein, the $D_H$ gene segment can have one nucleotide inserted or deleted at the V-D joint and/or the D-J joint of the nucleic acid encoding the $V_H$ chain to maintain the reading frame of the VH chain. The nucleotide insertion or deletion is chosen to maximize the hydrophilicity of the $D_H$. For example, a nucleotide from the 5' end of a $D_H$ is deleted and/or a nucleotide from the 3' end of a $D_H$ is deleted. In another example, a nucleotide is inserted at the 3' end of a $D_H$ sequence to add a nucleotide between the $D_H$ and $J_H$. The added nucleotide can be any nucleotide, in particular a guanine (G). The $J_H$ germline segment is an IGHJ1, IGHJ2, IGHJ3, IGHJ4, IGHJ5 or IGHJ6 and genes and alleles thereof, for example, any set forth in any of SEQ ID NOS:273-285. In examples of the human combinatorial antibody library provided herein, the J H gene segment can have one or more nucleotides inserted or deleted at the D-J joint of the nucleic acid sequence encoding a $V_H$ chain to maintain the reading frame of the VH chain. For example, the nucleotide insertion or deletion is chosen to maintain the reading frame of the $J_H$. In one examples, a nucleotide from the 5' end of the the $J_H$ is deleted. In another example, a nucleotide from the 3' end of the $J_H$ is deleted.

In the libraries provided herein, the VL chains in the members in the library are encoded by rearranged nucleic acid sequences encoding a kappa light chain combined by joining a human $V_\kappa$ germline segment and a $J_\kappa$ germline segment or are encoded by rearranged nucleic acid sequences encoding a lambda light chain combined by joining a human $V_\lambda$ germline segment and a $J_\lambda$ germline segment. The human $V_\kappa$ is an IGKV1, IGKV2, IGKV3, IGKV4, IGKV5 and IGKV6, and genes or alleles thereof, for example, any set forth in any of SEQ ID NOS: 286-355 and 868. In examples of the combinatorial antibody libraries provided herein, the $V_\kappa$ gene segment can have one or more nucleiotides inserted or deleted at the V-J joint of the nucleic acid molecule encoding the VL chain to maintain the reading frame of the VL chain. For example, a nucleotide is deleted at the 3' end of a $V_\kappa$. In another example, a nucleotide is inserted at the 3' end of a of a $V_\kappa$ nucleotide sequence to add a nucleotide between the $V_\kappa$ and $J_\kappa$. The nucleotide can be any nucleotide, in particular, the nucleotide is a guanine (G). The human $J_\kappa$ is an IGKJ1, IGKJ2, IGKJ3, IGKJ4 or IGKJ5 and genes and alleles thereof, for example, any set forth in any of SEQ ID NOS: 356-364. In examples of the combinatorial antibody libraries provided herein, the $J_\kappa$ gene segment has one or more nucleotides inserted or deleted at the V-J joint of the nucleic acid sequence encoding a VL chain to maintain the reading frame of the VL chain. The nucleotide insertion or deletion is chosen to maintain the reading frame of the $J_\kappa$. In some examples, a nucleotide from the 5' end of the $J_\kappa$ is deleted. The human $V_\lambda$ is an IGLV1, IGLV2, IGLV3, IGLV4, IGLV5, IGLV6, IGLV7, IGLV8, IGLV9, IGLV10 or IGLV11 and genes and alleles thereof, for example, any set forth in any of SEQ ID NOS:365-441. In examples of the combinatorial antibody libraries provided herein, the $V_\lambda$ has one or more nucleotides inserted or deleted at the V-J joint of the nucleic acid sequence encoding a VL to maintain the reading frame of the VL chain. For example, a nucleotide from the 3' end of a $V_\lambda$ nucleotide sequence is deleted. In another example, a nucleotide is inserted at the 3' end of a $V_\lambda$ nucleotide sequence to add a nucleotide between the $V_\lambda$ and $J_\lambda$. The nucleotide can be any nucleotide, in particular a guanine (G). The human $J_\lambda$ is an IGLJ1, IGLJ2, IGLJ3, IGLJ4, IGLJ5, IGLJ6 or IGLJ7 and genes and alleles thereof, for example, any set forth in any of SEQ ID NOS:442-451. In examples of the combinatorial antibody library provided herein, the $J_\lambda$ has one nucleotide inserted or deleted at the V-J joint of the nucleic acid sequence encoding a VL chain to maintain the reading frame of the VL chain. The nucleotide insertion or deletion can be chosen to maintain the reading frame of the $J_\lambda$. For example, a nucleotide from the 5' end of the $J_\lambda$ is deleted.

The human combinatorial antibody libraries contain a plurality of members each encoded by a plurality of nucleic acid molecules encoding a $V_H$ chain and a plurality of nucleic acid molecules encoding a VL chain. The plurality of nucleic acid molecules can correspond to all combinations or permutations of rearranged germline segments or a subset thereof. Generally, the libraries provided herein include libraries containing at or about 50, $10^2$, $10^3$, $10^4$, $2\times10^4$, $3\times10^4$, $4\times10^4$, $5\times10^4$, $6\times10^4$, $7\times10^4$, $8\times10^4$, $9\times10^4$, $10^5$, $10^6$, $10^7$, $10^8$, $10^9$ or more different members. For example, libraries provided herein include those that contain $10^3$, $2\times10^3$, $3\times10^3$, $4\times10^3$, $5\times10^3$, $6\times10^3$, $4\times10^3$, $7\times10^3$, $8\times10^3$, $9\times10^3$, $10^4$, $2\times10^4$, $3\times10^4$, $4\times10^4$, $5\times10^4$, $6\times10^4$, $7\times10^4$, $8\times10^4$, $9\times10^4$ or more different members.

For example, the plurality of nucleic acid molecules encoding a $V_H$ chain are generated from a subset of germline segments selected based on sequence similarities or differences, gene family, length, composition, CDR length or composition, species, functionality, specificity, group or subgroup. In one example, the plurality of nucleic acid molecules encoding a VH chain are generated from a subset of germline segments selected based on CDR and the CDR is CDR3. In another example, the plurality of nucleic acid molecules encoding a VH chain are selected based on gene family, whereby one germline segment from each of a $V_H$, $D_H$, and/or $J_H$ gene family is selected or one germline segment from a subset of a $V_H$, $D_H$, and/or $J_H$ gene family is selected. In such an example, the $V_H$ gene family is selected from among a IGHV1-18, IGHV1-2, IGHV1-24, IGHV1-3, IGHV1-45, IGHV1-46, IGHV1-58, IGHV1-69, IGHV1-8, IGHV2-26, IGHV2-5, IGHV2-5, IGHV2-70, IGHV3-11, IGHV3-13, IGHV3-15, IGHV3-16, IGHV3-20, IGHV3-21, IGHV3-23, IGHV3-30, IGHV3-33, IGHV3-35, IGHV3-38, IGHV3-43, IGHV3-48, IGHV3-49, IGHV3-53, IGHV3-64, IGHV3-66, IGHV3-7, IGHV3-72, IGHV3-73, IGHV3-74, IGHV3-9, IGHV4-28, IGHV4-31, IGHV4-34, IGHV4-39, IGHV4-4, IGHV4-59, IGHV4-61, IGHV5-51, IGHV6-1, and IGHV7-81; the $D_H$ gene family is selected from among a IGHD1-1, IGHD1-14, IGHD1-20, IGHD1-26, IGHD1-7, IGHD2-15, IGHD2-2, IGHD2-21, IGHD2-8, IGHD3-10, IGHD3-16, IGHD3-22, IGHD3-3, IGHD3-9, IGHD4-11, IGHD4-17, IGHD4-23, IGHD4-4, IGHD5-12, IGHD5-18, IGHD5-24, IGHD5-5, IGHD6-13, IGHD6-19, IGHD6-25, IGHD6-6 and IGHD7-27; and the $J_H$ gene family is selected from among a IGHJ1, IGHJ2, IGHJ3, IGHJ4, IGHJ5 and IGHJ6.

For example, the plurality of nucleic acid molecules encoding a VL chain are generated from a subset of germline segments selected based on sequence similarities or differences, gene family, length, composition, CDR length or composition, species, functionality, specificity, group, subgroup. In one example, the plurality of nucleic acid molecules encoding a VL chain are generated from a subset of germline segments selected based on CDR and the CDR is CDR3. In another example, the plurality of nucleic acid molecules encoding a $V_H$ chain are selected based on gene family, whereby one germline segment from each of a $V_\kappa$ and/or $J_\kappa$ or $V_\lambda$ and/or $J_\lambda$ gene family is selected or one germline segment from a subset of a $V_\kappa$ and/or $J_\kappa$ or $V_\lambda$ and/or $J_\lambda$ gene family is selected. In such an example, the $V_\kappa$ gene family is selected from among a IGKV1-12, IGKV1-12, IGKV1-16, IGKV1-17, IGKV1-27, IGKV1-33, IGKV1-37, IGKV1-39, IGKV1-5, IGKV1-6, IGKV1-8, IGKV1-9, IGKV1-NL1, IGKV1/OR2, IGKV1D-12, IGKV1D-13, IGKV1D-16, IGKV1D-17, IGKV1D-33, IGKV1-D-37, IGKV1-D-39, IGKV1D-42, IGKV1D-43, IGKV1D-8, IGKV2-24, IGKV2-28, IGKV2-29, IGKV2-30, IGKV2-30, IGKV2-40, IGKV2D-24, IGKV2D-26, IGKV2D-28, IGKV2D-29, IGKV2-D-30, IGKV2D-40, IGKV3-11, IGKV3-15, IGKV3-20, IGKV3-7, IGKV3-NL1, IGV3-NL2, IGKV3-NL3, IGKV3-NL4, IGKV3-NL5, IGKV3/OR2-268, IGKV3D-11, IGKV3D-15, IGKV3D-20, iGKV3D-7, IGKV4-1, IGKV5-2, IGKV6-21, IGKV6D-21, IGKV6D-41, and IGKV1-39; the $J_\kappa$ gene family is selected from among a IGKJ1, IGKJ2, IGKJ3, IGKJ4 and IGKJ5; the $V_\lambda$ gene family is selected from among a IGLV1-36, IGLV1-40, IGLV1-41, IGLV1-44, IGLV1-47, IGLV1-50, IGLV1-51, IGLV10-54, IGLV11-55, IGLV2-11, IGLV2-14, IGLV2-18, IGLV2-23, IGLV2-33, IGLV2-8, IGLV3-1, IGLV3-10, IGLV3-12, IGLV3-16, IGLV3-19, IGLV3-21, IGLV3-22, IGLV3-25, IGLV3-27, IGLV3-32, IGLV3-9, IGLV4-3, IGLV4-60, IGLV4-69, IGLV5-37, IGLV5-39, IGLV5-45, IGLV5-8, IGLV5-52, IGLV6-57, IGLV7-43, IGLV7-46, IGLV8-61, IGLV8-61and IGLV9-49; and the $J_\lambda$ gene family is selected from among a IGLJ1, IGLJ2, IGLJ4, IGLJ5, IGLJ6 and IGLJ7.

In any of the combinatorial antibody libraries provided herein, each antibody member in the library is productive and functional. Hence, in some examples, member antibodies in the library contains a VH chain and/or a VL chain that is encoded by a nucleic acid molecule that is modified to remove stop codons and/or restriction enzyme sites.

In any of the combinatorial antibody libraries provided herein, the $V_H$ chain is encoded by a nucleic acid molecule having a sequence of nucleotides set forth in any of SEQ ID NOS: 1059-1410, or a subset thereof and the VL chain is encoded by a nucleic acid molecule having a sequence of nucleotides set forth in any of SEQ ID NOS: 1411-1422, 1424-1439 and 1441-1471, or a subset thereof. The antibody libraries provided herein include libraries containing members whereby the $V_H$ chain has a sequence of amino acids set forth in any of SEQ ID NOS: 1475-1826 or a subset thereof and the VL chain has a sequence of amino acids set forth in any of SEQ ID NOS: 1827-1838, 1840-1855 and 1857-1888 or a subset thereof.

The human combinatorial antibody libraries provided herein include those having members that are full length antibodies or are fragments or portions thereof of antibodies, whereby the fragment or portion of the antibody is sufficient to form an antigen binding site. Thus, any of the the combinatorial antibody libraries provided herein can further contain all of a portion of a constant region, such that the portion of a constant region is sufficient to permit association of a heavy and light chain. Included among fragments or portions of antibody members in the libraries provided herein are a Fab, Fab', F(ab')$_2$, single-chain Fvs (scFv), Fv, dsFv, diabody, Fd and Fd' fragments Fab fragments, Fd fragments, scFv fragments, or a scFab fragments. For example, combinatorial antibody libraries provided herein are Fab libraries, whereby antibody members of the library are Fabs.

Provided herein is a library of nucleic acid molecules containing a plurality of addressable nucleic acid molecules encoding a variable light (VL) chain. In such libraries, each VL chain is encoded by a nucleic acid molecule containing a $V_\kappa$ and a $J_\kappa$ human germline segment or a $V_\lambda$ and a $J_\lambda$ human germline segment linked in-frame, whereby the nucleic acid molecule within each address is the same and is different from the nucleic acid molecules at all other addresses. Each nucleic acid member are formed from combination of germline segments such that the $V_\kappa$ and $J_\kappa$ or $V_\lambda$ and $J_\lambda$ germline segments of the nucleic acid molecule encoding a VL chain are linked such that the $V_\kappa$ segment is 5' to the $J_\kappa$ segment or the $V_\lambda$ segment is 5' to the $J_\lambda$ segment. The library includes a plurality of nucleic acid members that can include all permutations of all combinations of germline segments. In some examples, the plurality of nucleic acid members includes a subset of all germline segments such that a subset of germline $V_\kappa$ segments are linked with all or a subset of germline $J_\kappa$ segments, or all or a subset of germline $V_\lambda$ segments are linked to all or a subset of germline $J_\lambda$ segments to generate a plurality of nucleic acid molecules encoding a VL chain.

In the VL nucleic acid libraries provided herein, nucleic acid molecules encoded a VL chain are generated by by rearranged nucleic acid sequences combined by joining a human $V_\lambda$ germline segment and a $J_\kappa$ germline segment. The $V_\kappa$ is an IGKV1, IGKV2, IGKV3, IGKV4, IGKV5 or IGKV6, and genes and alleles thereof, for example any set forth in any of SEQ ID NOS:286-355 and 868. Included among the $V_\kappa$ germline segment contained in nucleic acid members in the libraries provided herein are any where the $V_\kappa$ has one or more nucleotides inserted or deleted a the V-J joint in the nucleic acid molecule encoding a VL to maintain the reading frame of the VL chain. For example, one or more nucleotides at the 3' end of the $V_\kappa$ nucleotide sequence is deleted. In other examples, one or more nucleotides is inserted at the 3' end of a $V_\kappa$ nucleotide sequence to add a nucleotide between the $V_\kappa$ and $J_\kappa$ germline segments. The nucleotide can be any nucleotide, and in particular is a guanine (G). The $J_\kappa$ germline segment is an IGKJ1, IGKJ2, IGKJ3, IGKJ4 and IGKJ5 and genes and alleles thereof, for example, any set forth in any of SEQ ID NOS: 356-364. Included among the $J_\kappa$ germline segment contained in nucleic acid members in the libraries provided herein are any where the $J_\kappa$ has one or more nucleotides inserted or deleted at the V-J joint to maintain the reading frame of the VL chain. The insertion or deletion is typically chosen to maintain the reading frame of the $J_\kappa$. For example, one or more nucleotides from the 5' end of the $J_\kappa$ is deleted.

In some examples, the VL nucleic acid libraries provided herein, nucleic acid molecules encoded a VL chain are generated by by rearranged nucleic acid sequences combined by joining a human $V_\lambda$ germline segment and a $J_\lambda$ germline segment. The $V_\lambda$ germline segment is an IGLV1, IGLV2, IGLV3, IGLV4, IGLV5, IGLV6, IGLV7, IGLV8, IGLV9, IGLV10 and IGLV11 and genes and alleles thereof, for example, any set forth in any of SEQ ID NOS: 365-441. Included among the $V_\lambda$ germline segment contained in nucleic acid members in the libraries provided herein are any where the $V_\lambda$ has one or more nucleotides inserted or deleted at the V-J joint of the nucleic acid molecule encoding a VL to maintain the reading frame of the VL chain. For example, one or more nucleotides is from the 3' end of a $V_\lambda$ nucleotide sequence is deleted. In another example, one or more nucleotides is inserted at the 3' end of a $V_\lambda$ nucleotide sequence to add a nucleotide between the $V_\lambda$ and $J_\lambda$. The nucleotide can be any nucleotide, in particular a guanine (G). The $J_\lambda$ germline segment is an IGLJ1, IGLJ2, IGLJ3, IGLJ4, IGLJ5, IGLJ6 and IGLJ7 and genes and alleles thereof, for example, any set forth in any of SEQ ID NOS: 442-451. Included among $J_\lambda$ germline segments contained in nucleic acid members in the libraries provided herein are any where the $J_\lambda$ has one or more nucleotides inserted or deleted at the V-J join of the nucleic acid molecule encoding a VL to maintain the reading frame of the VL chain. The insertion or deletion is typically chosed to maintain the reading frame of the $J_\lambda$. For example, a nucleotide from the 5' end of the $J_\lambda$ is deleted.

Any of the plurality of nucleic acid molecules encoding a VL chain in the libraries provided herein can be generated from a subset of germline segments selected based on sequence similarities or differences, gene family, length, composition, CDR length or composition, species, functionality, specificity, group, subgroup. For example, the plurality of nucleic acid molecules encoding a VL chain are generated from a subset of germline segments selected based on CDR and the CDR is CDR3. In another example, the plurality of nucleic acid molecules encoding a VL chain are selected based on gene family, whereby one germline segment from each of a $V_\kappa$ and/or $J_\kappa$ or $V_\lambda$ and/or $J_\lambda$ gene family is selected or one germline segment from a subset of a $V_\kappa$ and/or $J_\kappa$ or $V_\lambda$ and/or $J_\lambda$ gene family is selected. In such an example, a $V_\kappa$ germline segment can include any one or more germline segments from a IGKV1-12, IGKV1-12, IGKV1-16, IGKV1-17, IGKV1-27, IGKV1-33, IGKV1-37, IGKV1-39, IGKV1-5, IGKV1-6, IGKV1-8, IGKV1-9, IGKV1-NL1, IGKV1/OR2, IGKV1D-12, IGKV1D-13, IGKV1D-16, IGKV1-D-17, IGKV1D-33, IGKV1D-37, IGKV1D-39, IGKV1D-42, IGKV1D-43, IGKV1D-8, IGKV1-24, IGKV2-28, IGKV2-29, IGKV2-30, IGKV2-30, IGKV2-40, IGKV2D-24, IGKV2D-26, IGKV2D-28, IGKV2D-29, IGKV2-D-30, IGKV2D-40, IGKV3-11, IGKV3-15, IGKV3-20, IGKV3-7, IGKV3-NL1, IGV3-NL2, IGKV3-NL3, IGKV3-NL4, IGKV3-NL5, IGKV3/OR2-268, IGKV3D-11, IGKV3D-15, IGKV3D-20, IGKV3D-7, IGKV4-1, IGKV5-2, IGKV6-21, IGKV6D-21, IGKV6D-41, or IGKV1-39 gene family; a $J_\kappa$ germline segments can include any one or more germline segments from a IGKJ1, IGKJ2, IGKJ3, IGKJ4 and IGKJ5 gene family; a $V_\lambda$ germline segment can include any one or more germline segments from a IGLV1-36, IGLV1-40, IGLV1-41, IGLV1-44,IGLV1-47, IGLV1-50, IGLV1-51, IGLV10-54, IGLV11-55, IGLV2-11, IGLV2-14, IGLV2-18, IGLV2-23, IGLV2-33, IGLV2-8, IGLV3-1, IGLV3-10, IGLV3-12, IGLV3-16, IGLV3-19, IGLV3-21, IGLV3-22, IGLV3-25, IGLV3-27, IGLV3-32, IGLV3-9, IGLV4-3, IGLV4-60, IGLV4-69, IGLV5-37, IGLV5-39, IGLV5-45, IGLV5-8, IGLV5-52, IGLV6-57, IGLV7-43, IGLV7-46, IGLV8-61, IGLV8-61 and IGLV9-49 gene family; and/or a $J_\lambda$ germline segment can include any one or more germline segments from a IGLJ1, IGLJ2, IGLJ4, IGLJ5, IGLJ6 and IGLJ7 gene family.

In all of the nucleic acid libraries encoding a VL chain provided herein, the nucleic acid molecule encoding a VL chain can be modified to remove stop codons and/or restriction enzyme sites. Exemplary of nucleic acid molecules in the libraries provided herein include any of SEQ ID NOS:1411-1422, 1424-1439 and 1441-1471, or a subset thereof.

Provided herein is a library of nucleic acid molecules containing a plurality of addressable nucleic acid molecules encoding a variable light (VH) chain. In such libraries, each $V_H$ chain is encoded by a nucleic acid molecule containing a $V_H$, a $D_H$ and a $J_H$ human germline segment linked in-frame, whereby the nucleic acid molecule within each address is the same and is different from the nucleic acid molecules at all other addresses. Each nucleic acid member is formed from combination of germline segments such that the $V_H$, a $D_H$ and a $J_H$ human germline segment of the nucleic acid molecule encoding a VH chain are linked such that the $V_H$ segment is 5' to the $D_H$ segment which is 5' to the $J_H$ segment. The library includes a plurality of nucleic acid members that can include all permutations of all combinations of germline segments. In some examples, the plurality of nucleic acid members includes a subset of all germline segments such that a subset of germline $V_H$ segment are linked with all or a subset of germline $D_H$ segments which are linked with all or a subset of germline $J_H$ segments to generate the plurality of nucleic acid molecules encoding a VH chain.

In the VH nucleic acid libraries provided herein, nucleic acid molecules encoded a VH chain are generated by by rearranged nucleic acid sequences combined by joining a human $V_H$, $D_H$ and $J_H$ germline segments. The $V_H$ is an IGHV1, IGHV2, IGHV3, IGHV4, IGHV5, IGHV6 and IGHV7 and genes and alleles thereof, for example any set forth in any of SEQ ID NOS: 10-238. Included among the $V_H$ germline segment contained in nucleic acid members in the libraries provided herein are any where the $V_H$ has one or more nucleotides added or removed at the V-D joint in the nucleic acid molecule encoding a $V_H$ to maintain the reading frame of the VH chain. For example, one or more nucleotides at the 3' end of the $V_H$ nucleotide sequence is deleted. In other examples, one or more nucleotides is inserted or added at the 3' end of a $V_H$ nucleotide sequence to add a nucleotide between the $V_H$ and $D_H$ germline segments. The nucleotide can be any nucleotide, and in particular is a guanine (G). The $D_H$ germline segment is an IGHD1, IGHD2, IGHD3, IGHD4, IGHD5, IGHD6, and IGHD7 and genes and alleles thereof, for example, any set forth in any of SEQ ID NOS: 239-272. Included among the $D_H$ germline segment contained in nucleic acid members in the libraries provided herein are any where the $D_H$ has one or more nucleotides inserted or deleted at the V-D and/or the D-J joint to maintain the reading frame of the VH chain. The nucleotide insertion or deletion can be any nucleotide, but typically is chosen to maximize the hydrophilicity of the $D_H$. For example, one or more nucleotides from the 5' end of the $D_H$ is deleted. In other examples, a nucleotide from the 3' end of a $D_H$ is deleted. In further examples, a nucleotide is inserted at the 3' end of a $D_H$ sequence to add a nucleotide been the $D_H$ and $J_H$. The nucleotide can be any nucleotide, but typically is a guanine (G). The germline segment is an IGHJ1, IGHJ2, IGHJ3, IGHJ4, IGHJ5, and IGHJ6 and genes and alleles thereof, for example, any set forth in any of SEQ ID NOS:273-285. Included among the $J_H$ germline segment contained in nucleic acid members in the libraries provided herein are any where the $J_H$ has one or more nucleotides inserted or deleted at the D-J joint to maintain the reading frame of the VH chain. Typically, the nucleotide insertion or deletion is chosen to maintain the reading frame of the $J_H$. For example, one or more nucleotides from the 5' end of the $J_H$ is deleted. In another example, one or more nucleotides from the 3' end of the $J_H$ is deleted.

Any of the plurality of nucleic acid molecules encoding a VH chain in the libraries provided herein can be generated from a subset of germline segments selected based on sequence similarities or differences, gene family, length, composition, CDR length or composition, species, functionality, specificity, group, subgroup. For example, the plurality of nucleic acid molecules encoding a VH chain are generated from a subset of germline segments selected based on CDR and the CDR is CDR3. In another example, the plurality of nucleic acid molecules encoding a VH chain are selected based on gene family, whereby one germline segment from each of a $V_H$, $D_H$, and/or $J_H$ gene family is selected or one germline segment from a subset of a $V_H$, $D_H$, and/or $J_H$ gene family is selected. In such an example, a $V_H$ germline segment can include any one or more germline segments from a IGHV1-18, IGHV1-2, IGHV1-24, IGHV1-3, IGHV1-45, IGHV1-46, IGHV1-58, IGHV1-69, IGHV1-8, IGHV2-26, IGHV2-5, IGHV2-70, IGHV3-11, IGHV3-13, IGHV3-15, IGHV3-16,IGHV3-20, IGHV3-21, IGHV3-23, IGHV3-30, IGHV3-33, IGHV3-35, IGHV3-38, IGHV3-43, IGHV3-48, IGHV3-49,IGHV3-53, IGHV3-64, IGHV3-66, IGHV3-7, IGHV3-72, IGHV3-73, IGHV3-74, IGHV3-9, IGHV4-28, IGHV4-31, IGHV4-34, IGHV4-39, IGHV4-4, IGHV4-59, IGHV4-61, IGHV5-51, IGHV6-1 and IGHV7-81 gene family; a the $D_H$ germline segment can include any one ore more germline segments from a IGHD1-1, IGHD1-14, IGHD1-20, IGHD1-26, IGHD1-7, IGHD2-15, IGHD2-2, IGHD2-21, IGHD2-8, IGHD3-10, IGHD3-16, IGHD3-22, IGHD3-3, IGHD3-9, IGHD4-11, IGHD4-17, IGHD4-23, IGHD4-4, IGHD5-12, IGHD5-18, IGHD5-24, IGHD5-5, IGHD6-13, IGHD6-19, IGHD6-25, IGHD6-6, and IGHD7-27 gene family; and/or a $J_H$ germline segment can include any one or more germline segments from a IGHJ1, IGHJ2, IGHJ3, IGHJ4, IGHJ5 and IGHJ6 gene family.

In all of the nucleic acid libraries encoding a $V_H$ chain provided herein, the nucleic acid molecule encoding a $V_H$ chain can be modified to remove stop codons and/or restriction enzyme sites. Exemplary of nucleic acid molecules in the libraries provided herein include any of SEQ ID NOS: 1059-1410, or a subset thereof.

Also provided herein are libraries of addressable vectors containing any of the above nucleic acid molecules encoding a variable light (VL) chain or a variable heavy (VH) chain. Also provided herein are addressable cells, whereby each cell in the library contains any of the above different vectors.

Also provided herein are a library of nucleic acid molecules containing a plurality of addressable nucleic acid molecules encoding a variable light (VL) chain and a plurality of addressable nucleic acid molecules encoding a variable heavy (VH) chain (i.e. paired nucleic acid libraries). In such libraries, each VL chain is encoded by a nucleic acid molecule that contains a $V_\kappa$ and a $J_\kappa$ human germline segments or $V_\lambda$ and $J_\lambda$ germline segments linked in-frame and each VH chain is encoded by a nucleic acid molecule that contains a $V_H$, a $D_H$ and a $J_H$ human germline segment. The resulting nucleic acid members in the the nucleic acid molecule encoding the VL chain can be any provided herein and the nucleic acid molecule encoding the VH chain can be any provided herein. In such addressable libraries, each locus contains a nucleic acid molecule encoding a VH chain and a nucleic acid molecule encoding a VL chain, such that the combination of VH nucleic acid molecules and VL nucleic acid molecules within each address is different from the combination of nucleic acid molecules at all other addresses, i.e. the pairs of nucleic acid libraries at each locus are different.

Provided herein is a method of generating human combinatorial antibody libraries. The method includes the steps of a) combining a $V_H$, a $D_H$ and a $J_H$ human germline segment or portion thereof in frame to generate a sequence of a nucleic acid molecule encoding a VH chain or a portion thereof and b) combining a $V_\kappa$ and a $J_\kappa$ human germline segment or portion thereof, or a $V_\lambda$ and a $J_\lambda$ germline segment or portion thereof in frame to generate a sequence of a nucleic acid molecule encoding a VL chain or a portion thereof. In the method provided herein each of the portions of the $V_H$, $D_H$, $J_H$, $V_\kappa$, $J_\kappa$, $V_\lambda$ or $J_\lambda$ in step a) and b) are sufficient to produce an antibody or portion thereof containing a VH or VL or portion thereof that forms a sufficient antigen binding site. In the methods, steps a) and b) are repeated a plurality of times to generate sequences of a plurality of different nucleic acid molecules. The nucleic acid molecules are synthesized to produce two libraries, whereby the first library contains nucleic acid molecules encoding a $V_H$ chain or portion thereof and the the second library contains nucleic acid molecules encoding a VL chain or a portion thereof. In the method, a nucleic acid molecule from the first library and from the second library are introduced into a cell (e.g. together such as by co-transformation). The step of introducing nucleic acids into cells is repeated a plurality of times with different pairs of nucleic acid molecules from the first library and the second library resulting in that contain nucleic acid molecules encoding a VH chain and a nucleic acid molecule encoding a VL chain such that the nucleic acid molecules encode a different combination of VH and VL chains from every other cell. The cells are grown to express the antibodies or portions thereof in each cell, thereby producing a plurality of antibodies or portion thereof. The plurality of produced antibody or portion thereof contains a VH and a VL or a sufficient portion thereof to form an antigen binding site and the antibodies or portions thereof are different from those at every other antibody or portions thereof in the library.

The human combinatorial library produced by the method provided herein can be provided as an addressable library. In such methods, each of the various steps can be performed in an addressed format so that throughout the steps of the method the identity of the germline segments, the recombined nucleic acid sequence and/or produced antibody or portion thereof are known by their address. For example, the synthesized nucleic acid sequences are individually addressed, thereby generating a first addressed nucleic acid library and a second addressed nucleic acid library. The nucleic acid molecules can be introduced into addressed cells, whereby each locus contains a cell that contains nucleic acid molecules encoding a different combination of a VH and a VL from every other cell in the addressed library of cells. Upon expression of the antibodies, addressed antibodies are produced whereby each locus contains an antibody containing a VH chain and a VL chain or a portion thereof sufficient to form an antigen binding site. The antibodies or portions thereof at each locus is the same and is different from those at each and every other locus. Hence, the identify of the antibody or portion thereof is known by its address.

In the method of generating a human combinatorial antibody library provided herein, in step a) the $V_H$, $D_H$ and $J_H$ germline segments or portions thereof of the nucleic acid molecule encoding a VH chain are combined such that the $V_H$ segment is 5' to the $D_H$ segment which is 5' to the $J_H$ segment; and in step b) the $V_\kappa$ and $J_\kappa$ or $V_\lambda$ and $J_\lambda$ germline segments or portions thereof of the nucleic acid molecule encoding a VL chain are linked such that the $V_\kappa$ segment is 5' to the $J_\kappa$ segment or the $V_\lambda$ segment is 5' to the $J_\lambda$ segment. Steps a) and/or b) can be performed manually or can be performed in silico, such as by a computer or computer system capable of or programmed to execute computer-readable instructions based on an algorithm for performing a method of combining human germline segments.

In the method provided herein for generating a human combinatorial antibody library, step a) includes the steps of selecting a $V_H$, a $D_H$ and a $J_H$ germline segment or portion thereof, generating a V-D joint by modifying the germline sequence of the $V_H$ and/or $D_H$ germline segments by insertion or deletion of one or more nucleotides in order to maximize the hydrophilicity of the $D_H$ germline segment, generating a D-J joint by modifying the germline sequence of the $D_H$ and/or $J_H$ germline segments by insertion or deletion of one or more nucleotides to maintain the reading frame of the $J_H$, and combining the resulting $V_H$, $D_H$, and $J_H$, to generate a sequence of a nucleic acid molecule encoding a $V_H$ chain. In such a method, the V-D joint can be generated by deletion of one or more, for example one, nucleotide from the 5' end of the $D_H$ germline segment. In another example, the V-D joint can be generated by deleting one or more nucleotides from the 3' end of the $V_H$ germline segment. In a further example, the V-D joint can be generated by inserting one or more nucleotides at the 5' end of the $D_H$ germline segment. For example, the inserted or added nucleotide or nucleotides can be any nucleotide, and in particular is a guanine (G). Further, the D-J joint can be generated by deletion of one or more nucleotides from the 5' end of the $J_H$. In another example, the D-J joint is generated by inserting a nucleotide from the 3' end of the $D_H$ germline segment. The inserted or added nucleotide or nucleotides can be any nucleotide, and in particular is a guanine (G).

In the method provided herein for generating a human combinatorial antibody library, step b) includes the steps of selecting $V_\kappa$ and $J_\kappa$ or $V_\lambda$ and $J_\lambda$ germline segment or portion thereof, generating a V-J joint by modifying the germline sequence of the $V_\kappa$ or $J_\kappa$ by insertion or deletion of one or more nucleotides to maintain the reading frame of the $J_\kappa$, or by modifying the germline sequence of the $V_\lambda$ or $J_\lambda$ by insertion or deletion of one or more nucleotides to maintain the reading frame of the $J_{,\lambda}$, and combining the resulting $V_\kappa$ and $J_\kappa$ or $V_\lambda$ and $J_\lambda$ to generate a sequence of a nucleic acid molecule encoding a VL chain. In such a method, the V-J joint can be generated by deletion of one or more, for example one, nucleotide from the 5' end of the of the $J_\kappa$ or $J_\lambda$ germline segment. In another example, the V-J joint can be generated by deleting one or more nucleotides from the 3' end of the $V_\lambda$ or $V_\lambda$ germline segment. In a further example, the V-J joint can be generated by inserting one or more nucleotides at the 5' end of the $J_\kappa$ or $J_\lambda$ germline segment. For example, the inserted or added nucleotide or nucleotides can be any nucleotide, and in particular is a guanine (G).

In the methods of generating a combinatorial library provided herein, steps a) and b) are repeated a plurality of times. Repeating step a) a plurality of times includes selecting N1 (i.e. a first number) of different $V_H$ germline segments, selecting N2 (i.e. a second number) of different $D_H$ germline segments and selecting N3 (a third number) of different $J_H$ sequences. The N1, N2 and N3 numbers can be the same or different, and can include all respective germline segments or a subset thereof. Generally, the N1, N2 and N3 are a number of germline segments that can be all or a subset of $V_H$, $D_H$ or $J_H$ germline segments, respectively. In the method of repeating step a) a plurality of times, all possible combination of $V_H$, $D_H$ and $J_H$ combinations are made to generate N1×N2×N3 different nucleic acid sequences encoding a $V_H$ chain.

For example, in the method of generating a human combinatorial antibody library provided herein, a $V_H$ germline segment (including N1 different $V_H$ germline segments) can be selected from all or a subset of an IGHV1, IGHV2, IGHV3, IGHV4, IGHV5, IGHV6 or IGHV7 and genes and alleles thereof, for example, a $V_H$ germline segment set forth in any of SEQ ID NOS: 10-238. A $D_H$ germline segment can be selected from all or a subset of an IGHD1, IGHD2, IGHD3, IGHD4, IGHD5, IGHD6, or IGHD7 and genes and alleles thereof, for example, a $D_H$ germline segment set forth in any of SEQ ID NOS: 239-272. A $J_H$ germline segment can be selected from all or a subset of IGHJ1, IGHJ2, IGHJ3, IGHJ4, IGHJ5, or IGHJ6 and genes and alleles thereof, for example, a $J_H$ germline segment set forth in any of SEQ ID NOS: 273-285.

In any of the above examples, the method can include in step a) selecting a subset of germline segments based on sequence similarities or differences, gene family, length, composition, CDR length or composition, species, functionality, specificity, group or subgroup. For example, the subset of germline segments can be selected based on gene family. In the methods, germline segments can be selected such that one germline segment from each of a a $V_H$, $D_H$, and/or $J_H$ gene family is selected or one germline segment from a subset of a $V_H$, $D_H$, and/or $J_H$ gene family is selected. $V_H$ gene families include, but are not limited to, a IGHV1-18, IGHV1-2, IGHV1-24, IGHV1-3, IGHV1-45, IGHV1-46, IGHV1-58, IGHV1-69, IGHV1-8, IGHV2-26, IGHV2-5, IGHV2-70, IGHV3-11, IGHV3-13, IGHV3-15, IGHV3-16, IGHV3-20, IGHV3-21, IGHV3-23, IGHV3-30, IGHV3-33, IGHV3-35, IGHV3-38, IGHV3-43, IGHV3-48, IGHV3-49, IGHV3-53, IGHV3-64, IGHV3-66, IGHV3-7, IGHV3-72, IGHV3-73, IGHV3-74, IGHV3-9, IGHV4-28, IGHV4-31, IGHV4-34, IGHV4-39, IGHV4-4, IGHV4-59, IGHV4-61, IGHV5-51, IGHV6-1 and IGHV7-81 gene families including genes and alleles thereof. $D_H$ gene families include, but are not limited to, a IGHD1-1, IGHD1-14, IGHD1-20, IGHD1-26, IGHD1-7, IGHD2-15, IGHD2-2, IGHD2-21, IGHD2-8, IGHD3-10, IGHD3-16, IGHD3-22, IGHD3-3, IGHD3-9, IGHD4-11, IGHD4-17, IGHD4-23, IGHD4-4, IGHD5-12, IGHD5-18, IGHD5-24, IGHD5-5, IGHD6-13, IGHD6-19, IGHD6-25, IGHD6-6, and IGHD7-27, gene families including genes and alleles thereof. The $J_H$ gene families include, but are not limited to, a IGHJ1, IGHJ2, IGHJ3, IGHJ4, IGHJ5 and IGHJ6 gene families including genes and alleles thereof.

In the methods of generating a combinatorial library provided herein, steps a) and b) are repeated a plurality of times. Repeating step b) a plurality of times includes selecting N1 (i.e. a first number) of different $V_\lambda$ germline segments and selecting N2 (i.e. a second number) different $J_\lambda$ germline segments or selecting N3 (a third number) of different $V_\kappa$ germline segments and selecting N4 (i.e. a fourth number) of different $J_\kappa$ germline segments. The N1, N2, N3 and N4 numbers can be the same or different, and can include all respective germline segments or a subset thereof. Generally, the N1, N2, N3 and N4 are a number of germline segments that can be all or a subset of $V_\lambda$, $J_\lambda$, $V_\kappa$, $J_\kappa$ germline segments, respectively. In the method of repeating step b) a plurality of times, all possible combination of $V_\lambda$, $J_\lambda$, $V_\kappa$, $J_\kappa$ combinations are made to generate N1×N2 or N3×N4 different nucleic acid sequences encoding a VL chain.

For example, in the method of generating a human combinatorial antibody library provided herein, a $V_\lambda$ germline segment (including N1 different $V_\lambda$ germline segments) can be selected from all or a subset of an IGLV1, IGLV2, IGLV3, IGLV4, IGLV5, IGLV6, IGLV7, IGLV8, IGLV9, IGLV10 and IGLV11 and genes and alleles thereof, for example, a $V_\lambda$ germline segment set forth in any of SEQ ID NOS: 365-441. A $J_\lambda$ germline segment can be selected from all or a subset of an IGLJ1, IGLJ2, IGLJ3, IGLJ4, IGLJ5, IGLJ6 and IGLJ7 and genes and alleles thereof, for example, a $J_\lambda$ germline segment set forth in any of SEQ ID NOS: 442-451. A $V_\kappa$ germline segment can be selected from all or a subset of IGKV1, IGKV2, IGKV3, IGKV4, IGKV5 and IGKV6, and genes and alleles thereof, for example, a $V_\kappa$ germline segment set forth in any of SEQ ID NOS: 286-355 and 868. A $J_\kappa$ germline segment can be selected from all or a subset of a IGKJ1, IGKJ2, IGKJ3, IGKJ4 and IGKJ5 and genes and alleles thereof, for example, a $J_\kappa$ germline segment set forth in any of SEQ ID NOS: 356-364.

In any of the above examples, the method can include in step b) selecting a subset of germline segments based on sequence similarities or differences, gene family, length, composition, CDR length or composition, species, functionality, specificity, group or subgroup. For example, the subset of germline segments can be selected based on gene family. In the methods, germline segments can be selected such that one germline segment from each of a $V_\kappa$ and/or $J_\kappa$ or $V_\lambda$ and/or $J_\lambda$ gene family is selected or one germline segment from a subset of a $V_\kappa$ and/or $J_\kappa$ or $V_\lambda$ and/or $J_\lambda$ gene family is selected. $V_\kappa$ gene families include, but are not limited to, a IGKV1-12, IGKV1-12, IGKV1-16, IGKV1-17, IGKV1-27, IGKV1-33, IGKV1-37, IGKV1-39, IGKV1-5, IGKV1-6, IGKV1-8, IGKV1-9, IGKV1-NL1, IGKV1/OR2, IGKV1D-12, IGKV1D-13, IGKV1D-16, IGKV1-D-17, IGKV1D-33, IGKV1D-37, IGKV1D-39, IGKV1D-42, IGKV1D-43, IGKV1D-8, IGKV2-24, IGKV2-28, IGKV2-29, IGKV2-30, IGKV2-30, IGKV2-40, IGKV2D-24, IGKV2D-26, IGKV2D-28, IGKV2D-29, IGKV2-D-30, IGKV2D-40, IGKV3-11, IGKV3-15, IGKV3-20, IGKV3-7, IGKV3-NL1, IGV3-NL2, IGKV3-NL3, IGKV3-NL4, IGKV3-NL5, IGKV3/OR2-268, IGKV3D-11, IGKV3D-15, IGKV3D-20, IGKV3D-7, IGKV4-1, IGKV5-2, IGKV6-21, IGKV6D-21, IGKV6D-41, and IGKV1-39 gene families including genes and alleles thereof. $V_\lambda$ gene families include, but are not limited to, a IGLV1-36, IGLV1-40, IGLV1-41, IGLV1-44, IGLV1-47, IGLV1-50, IGLV1-50, IGLV1-51, IGLV10-54, IGLV11-55, IGLV2-11, IGLV2-14, IGLV2-18, IGLV2-23, IGLV2-33, IGLV2-8, IGLV3-1, IGLV3-10, IGLV3-12, IGLV3-16, IGLV3-19, IGLV3-21, IGLV3-22, IGLV3-25, IGLV3-27, IGLV3-32, IGLV3-9, IGLV4-3, IGLV4-60, IGLV4-69, IGLV5-37, IGLV5-39, IGLV5-45, IGLV5-8, IGLV5-52, IGLV6-57, IGLV7-43, IGLV7-43, IGLV7-46, IGLV8-61, IGLV8-61 and IGLV9-49 gene families including genes and alleles thereof. The $J_\lambda$ gene families include, but are not limited to, a IGLJ1, IGLJ2, IGLJ4, IGLJ5, IGLJ6 and IGLJ7 gene families including genes and alleles thereof.

In any of the methods above of generating a human combinatorial antibody library, the germline segments can be included in a user-created database, for example, to provide convenient access to such sequences. In practicing the method, the sequences of the $J_H$, $J_\kappa$, and $J_\lambda$ germline segment in the database are set forth in their correct reading frame (e.g., such as is set forth in Table 13).

The methods provided herein can further include a step after steps a) and/or b) of modifying the nucleic acid sequences encoding a VH chain or a portion thereof and/or modifying the nucleic acid sequences encoding a VL chain or a portion thereof. For example, the nucleic acid sequences can be modified by removing any internal stop codons. Generally, modification of stop codon(s) is made by making only one or two nucleotide changes to the nucleic acid sequences. The codon triplet for a stop codon can be changed to any other codon triplet encoding an amino acid. For example, the stop codon TAA can be modified to be TAT, the stop codon TAG can be modified to be TAT and the stop codon TGA can be modified to be TCA. In another example, the nucleic acid sequences can be modified by removing any internal restriction sites. The nucleotides recognized by a restriction enzyme can be modified to any other nucleotide sequence so long as the sequence is not recognized by a restriction enzyme of interest, i.e. one used in subsequent cloning steps. Generally, only one or two nucleotides changes are made. Typically, modification of restriction sites are made to maximize codon usage in *E. coli*.

In the methods of generating a human combinatorial antibody library provided herein, the plurality of nucleic acid sequences encoding a $V_H$ chain include, but are not limited to, any set forth in any of SEQ ID NOS: 1059-1410, or a subset thereof. The plurality of nucleic acid sequences encoding a VL chain include, but are not limited to, any set forth in any of SEQ ID NOS: 1411-1422, 1424-1439 and 1441-1471, or a subset thereof.

In any of the methods provided herein of generating a human combinatorial antibody library, the plurality of nucleic acid sequences encoding a VH chain and/or the plurality of nucleic acid sequences encoding a VL chain can be ranked. For example, the sequences can be ranked based on sequence similarity (e.g. performed by sequence alignment or other methods known in the art and described herein). The sequence similarity between and among the plurality of different nucleic acid molecules encoding a VH chain and/or the sequence similarity between and among the plurality of different nucleic acid molecules encoding a VL chain can be determined. A subset of nucleic acid sequences encoding a VH chain and/or a VL chain can be selected (e.g. for synthesis and subsequent expression) such that the selected sequences include those that are the most similar or are the most different from other selected sequences.

In the method provided herein for generating a combinatorial antibody library, the synthesized nucleic acid sequences in the addressed libraries are contained in vectors. Hence, a vector from a first vector library containing nucleic acid sequences encoding a VH chain and a vector from a second vector library containing nucleic acid sequences encoding a VL chain are introduced into addressed cells for generation and production of antibody members of the library. The vector can further contain all or a portion of a constant region sufficient to permit association of heavy and light chains. For example, the vector can contain a $C_{H1}$ and $C_L$ such that the resulting encoded antibody is a Fab. In the methods provided herein, the cells include prokaryotic or eukaryotic cells. For example, cells include *E. coli* cells. In the methods of generating a combinatorial antibody library provided herein, the addressed cells can be arranged in a spatial array. The spatial array includes, for example, a multi-well plate such that each individual locus of the plate corresponds to a cell that contains nucleic acid molecules encoding a different combination of a VH and a VL compared to every other cell in the addressed library of cells.

The antibody or portions thereof that are expressed in the method provided herein include a full length antibody or a fragment or portion thereof sufficient to form an antigen binding site. For example, the expressed antibody is a Fab. The methods provided herein, further can include a step of purifying the antibodies or portions thereof. The antibodies or portion thereof in the libraries include those that are 70%, 75%, 80%, 85%, 90%, 91%, 92%, 93%, 94%, 95%, 96%, 97%, 98% or 99% pure. Hence, the addressable library includes antibody members that are purified such that the purified antibodies or portions thereof are addressed, and the antibody within each address is the same antibody and is different from all other antibodies at all other addresses in the library.

Also provided herein, is an addressable combinatorial antibody library produced by the method provide herein of generating a combinatorial antibody library. Such an antibody library includes members each containing a VH chain having a sequence of amino acids selected from among any of SEQ ID NOS: 1475-836 and a VL chain having a sequence of amino acids selected from among any of SEQ ID NOS: 1827-1838, 1840-1855 and 1857-1888.

Provided herein is a method of screening a human combinatorial antibody library for binding or activity against a target protein to identify antibodies or portions thereof that bind to a target protein and/or modulate an activity of a target protein. In such methods, a human combinatorial antibody library is provided. The library includes any human combinatorial antibody library provided herein or any human combinatorial antibody library produced by the methods provided herein. In such methods, the an antibody or portion thereof in the library is contacted with a target protein and binding of the antibody or portion thereof with the target protein and/or modulation of a functional activity by an antibody or portion thereof in the library is assessed. Antibodies or portions thereof that bind to the target protein and/or modulate an activity of the target protein are identified, whereby the identified antibody or portion thereof is designated as a "HIT." In such methods, for example, the human combinatorial antibody library is an addressable library and contacting is performed in an addressable array, such that the identity of the "Hit" is known by its address. For example, screening is performed in a spatial array, such as a microwell plate.

In the methods of screening provided herein, the target protein is a membrane-bound protein, a cell surface receptor (CSR) or a CSR ligand. The membrane-bound protein or CSR includes, but is not limited to, a cytokine receptor, a receptor kinase, a receptor phosphatase, a receptor involved in cell-cell interactions or a cellular adhesion molecule. For example, the target protein includes, but is not limited to, VEGFR-1, VEGFR-2VEGFR-3, a epidermal growth factor receptor (EGFR), ErbB-2, ErbB-b3, IGF-R1, C-Met, TNF-R1, TNF-R2, BTLA, HVEM, LT-13R, CD20, CD3, CD25, NOTCH, DLL4, G-CSF-R, GM-CSF-R, EPO-R, a cadherin, an integrin, CD52 and CD44, a VEGF-A, VEGF-B, VEGF-C, VEGF-D, PIGF, EGF, HGF, TNF-α, LIGHT, lymphotoxin (LT), IgE, G-CSF, GM-CSF and EPO.

In some examples, the binding of the antibody or portion thereof to the target protein is assessed. In other examples, modulation of a functional activity of the target protein by an antibody or portion thereof is assessed. The functional activity includes, but is not limited to, cellular proliferation, lymphoma apoptosis, chemotaxis, cancer cell invasion, matrigel, endothelial proliferation, tube formation and signal transduction.

In the methods of screening provided herein, binding can be assessed on cells and/or a functional activity can be assessed in a cell-based activity. In such examples, the cells express the target protein, typically on their surface as a membrane-bound or extracellular receptor, ligand or adhesion protein. For example, the cells can be transiently or stably expressed with a nucleic acid molecule encoding the target protein.

Provided herein is a method of screening that includes after identifying a "Hit", for example, in a previous iteration of the method of screening as provided above, a second library combinatorial antibody library is provided. In such examples, the second combinatorial antibody library is based on the identified "Hit." For example, the second library is generated by selecting $V_H$, $D_H$ and $J_H$ human germline segments that are related by sequence similarity to the germline segments of the identified HIT(s), and combining all possible $V_H$, $D_H$ and $J_H$ human germline segments or portions thereof in frame to generate a plurality of sequences of nucleic acid molecules each encoding a different VH chain or a portion thereof and selecting $V_\kappa$ and a $J_\kappa$ or $V_\lambda$ and a $J_\lambda$ human germline segments that are related by sequence similarity to the germline segments of the identified HIT(s), and combining all possible $V_\kappa$ and a $J_\kappa$ human germline segments or portions thereof, or all possible $V_\lambda$ and a $J_\lambda$ germline segment or portions thereof in frame to generate a plurality of sequences of nucleic acid molecule each encoding a different VL chain or a portion thereof. The portions of the $V_H$, $D_H$, $J_H$, $V_\kappa$, $J_\kappa$, $V_\lambda$ or $J_\lambda$ are sufficient to produce an antibody containing a VH or VL or portion thereof that is sufficient to bind to an antigen. Upon combination of the germline segments, the nucleic acid molecules are synthesized to produce a first library that contains nucleic acid molecules encoding a VH chain or a portion thereof and a second library that contains nucleic acid molecules encoding a VL chain or a portion thereof. A nucleic acid molecule from the first library and from the second library is introduced into a cell and the steps are repeated a plurality of times to produce a library of cells such that each cell contains nucleic acid molecules encoding a different combination of VH and VL from every other cell in the library of cells. The cells are grown to express the antibodies in each cell, thereby producing a plurality of antibodies or portion thereof such that each produced antibody or portion thereof in the library contains a different combination of a VH and a VL chain or a sufficient portion thereof to form an antigen binding site from all other antibodies or portions thereof in the library. The antibodies are further purified to generate a second human combinatorial antibody library. In such examples, the second human combinatorial antibody library is generated such that the sequence similarity between and among related germline segments is or is about 60%, 65%, 70%, 75%, 80%, 85%, 90%, 91%, 92%, 93%, 94%, 95%, 96%, 97%, 98%, 99% or more.

In another example, a second combinatorial antibody library is provided that is generated by selecting a plurality of nucleic acid molecules encoding a VH chain that contain a $V_H$, a $D_H$ or a $J_H$ human germline segment that is the same as contained in the nucleic acid molecule encoding the identified HIT and selecting a plurality of nucleic acid molecules encoding a VL chain that contains a $V_\kappa$ and a $J_\kappa$ or a $V_\lambda$ and a $J_\lambda$ human germline segment that is the same as contained in the nucleic acid molecule encoding the identified HIT. A nucleic acid molecule from the plurality of nucleic acid molecules encoding a VL and a nucleic acid molecule from the plurality of nucleic acid molecules encoding a VH are introduced into a cells and the cells are grown. This is repeated a plurality of times to produce a library of cells, whereby each cells contains nucleic acid molecules encoding a different combination of a VH and a VL chain from every other cell in the library. Upon expression of the antibodies in each cell, a plurality of antibodies or portions thereof is produced. Each antibody or portion thereof in the library contains a different combination of a VH and a VL chain or a sufficient portion thereof to form an antigen binding site from all other antibodies or portions thereof in the library. The antibodies or portions thereof are purified to generate a second combinatorial antibody library.

In additional examples, a second combinatorial library is provided based on the identified HIT(s) that is generated by introducing amino acid mutations into the "HIT" to generate a plurality of antibodies or portions thereof. Each antibody member or portion thereof in the second combinatorial antibody library differs from the identified "HIT" by one or more amino acid mutations in its primary sequence. In such examples, the amino acid mutations are in the complementarity determining regions (CDRs) of the identified HIT.

In each of the methods above, the second human combinatorial library is contacted with a target protein and binding of the antibody or portion thereof with the target protein and/or modulation of a functional activity by an antibody or portion thereof in the library is assessed. Antibodies or portions thereof that bind to the target protein and/or modulate an activity of the target protein are identified, whereby the identified antibody or portion thereof is designated as a further "HIT." In some examples, the second combinatorial antibody library is an addressable library such that the purified antibodies or portions thereof are addressed and each purified antibody within each address is the same antibody and is different from the antibodies at all other addresses. In such examples, contacting is performed in an addressable array, such that the identity of the "Hit" is known by its address. For example, screening is performed in a spatial array, such as a microwell plate.

In any of the examples of screening provided above, the method is repeated iteratively until a further "HIT" is identified having an optimized binding affinity for a target protein and/or having an activity that is optimized against a target protein compared to previous "HITS" in earlier iterations of the method.

Provided herein is an anti-DLL4 antibody that contains a VH chain encoded by a sequence of nucleotides compiled from a $V_H$, $D_H$ and $J_H$ germline segment and a VL chain encoded by a sequence of nucleotides compiled from a $V_\kappa$ and $J_\kappa$ or $V_\lambda$ and $J_\lambda$ germline segments. The $V_H$ germline segment is an IGHV1, and IGHV5 or an IGHV6 or genes and alleles thereof; the $D_H$ germline segment is an IGHD6, and IGHD5 or an IGHD3 or genes and alleles thereof; and the $J_H$ germline segment is an IGHJ1 or an IGHJ4 or genes and alleles thereof. The $V_\kappa$ germline segment is a IGKV3 and the JK is a IGKJ1 or genes and alleles thereof; the $V_\lambda$ germline segment is a IGLV8 or an IGLV5 and the $J_\lambda$ germline segment is a IGLJ1 or a IGLJ4 or genes and alleles thereof. The anti-DLL4 antibodies provided herein bind DLL4 and/or modulates an activity of DLL4.

In some examples, the $V_H$ germline segment is an IGHV1-46*01, IGHV1-46*02 or an IGHV1-46*03 or an IGHV6-1*01 or an IGHV6-1*02. The $D_H$ germline segment is an IGHD6-6*01, IGHD5-18*01, IGHD3*01 or IGHD3-3*02. The $J_H$ germline segment is an IGHJ1*01, IGHJ4*01, IGHJ4*02 or IGHJ4*03. The $V_\kappa$ germline segment is an IGKV3-11*01 or IGKV3-11*02. The JK germline segment is a IGKJ1*01. The $V_\lambda$ germline segment is a IGLV8-61*01, IGLV8-61*02, IGLV8-61*03 or IGLV5-48*01. The $J_\lambda$ germline segment that is a IGLJ1*01 or IGLJ4*01. For example, The anti-DLL4 antibody provided herein is an antibody or portion thereof containing a a $V_H$ chain encoded by a sequence of nucleotides compiled from an IGHV1-46*01, IGHD6-6*01 and IGHJ1*01 and a VL chain encoded by a sequence of nucleotides compiled from IGKV3-11*01 and IGKJ1*01 germline segments; a VH encoded by a sequence of nucleotides compiled from IGHV5-51*03, IGHD5-18*01 and IGHJ4*01 germline segments and a VL chain encoded by a sequence of nucleotides compiled from an IGLV8-61*01 and IGLJ1*01 germline segments; or a VH chain encoded by a sequence of nucleotides compiled from an IGHV6-1*01, and IGHD3-3*01 and an IGHJ4*01 germline segments and a VL chain encoded by a sequence of nucleotides compiled from an IGLV5-48*01 and a IGLJ4*01 germline segments. Anti-DLL4 antibodies provided herein include, but are not limited to, antibodies containing a $V_H$ chain having a sequence of amino acids set forth in SEQ ID NO: 1513 and a VL chain having a sequence of amino acids set forth in SEQ ID NO:1850; a VH chain having a sequence of amino acids set forth in SEQ ID NO: 1803 and a VL chain having a sequence of amino acids set forth in SEQ ID NO:1881; or a V_H chain having a sequence of amino acids set forth in SEQ ID NO: 1812 and a VL chain having a sequence of amino acids set forth in SEQ ID NO:1884. For example, exemplary of an anti-DLL4 antibody provided herein is an antibody containing a VH chain having a sequence of amino acids set forth in SEQ ID NO: 1513 and a VL chain having a sequence of amino acids set forth in SEQ ID NO:1850 Antibodies that include portions of any of the above antibodies that form a sufficient antigen binding site that bind to anti-DLL4 and/or modulate an activity of DLL4 also are provided. Also provided are any antibodies that contain conservative amino acid changes in their sequence compared to any of the antibodies provided herein.

Provided herein is an anti-EpoR antibody containing a VH chain encoded by a sequence of nucleotides compiled from a $V_H$, $D_H$ and $J_H$ germline segment and a VL chain encoded by a sequence of nucleotides compiled from a $V_\kappa$ and $J_\kappa$ germline segments. The $V_H$ germline segment is an IGHV1 or genes and alleles thereof. The $D_H$ germline segment is an IGHD6 or an IGHD3 or genes and alleles thereof. The $J_H$ germline segment is an IGHJ1 or genes and alleles thereof. The $V_\kappa$ germline segment is an IGKV4. The $J_\kappa$ is an IGKJ1. The anti-EpoR antibodies provided herein bind EpoR and/or modulate an activity of EpoR.

In some examples, the $V_H$ germline segment is an IGHV1-46*01, IGHV1-46*02 or an IGHV1-46*03. The the $D_H$ germline segment is an IGHD6-6*01, IGHD3-10*01 or IGHD3-10*02. The $J_H$ germline segment is an IGHJ1*01, IGHJ4*01, IGHJ4*02 or IGHJ4*03. The $V_\kappa$ germline segment is an IGKV4-1*01. the $J_\kappa$ germline segment that is a IGKJ1*01. For example, the anti-EpoR antibody provided herein contains a VH chain encoded by a sequence of nucleotides compiled from an IGHV1-46*01, IGHD3-10*01 and IGHJ4*01 and a VL chain encoded by a sequence of nucleotides compiled from IGKV4-1*01 and IGKJ1*01 germline segments or contains a VH chain encoded by a sequence of nucleotides compiled from IGHV1-46*01, IGHD6-6*01 and IGHJ1*01 germline segments and a VL chain encoded by a sequence of nucleotides compiled from an IGKV4-1*01 and IGKJ1*01 germline segments. Anti-EpoR antibodies provided herein include, but are not limited to, an antibody containing a $V_H$ chain having a sequence of amino acids set forth in SEQ ID NO: 1509 and a VL chain having a sequence of amino acids set forth in SEQ ID NO:1838; or a VH chain having a sequence of amino acids set forth in SEQ ID NO: 1513 and a VL chain having a sequence of amino acids set forth in SEQ ID NO:1838. Antibodies that include portions of any of the above antibodies that form a sufficient antigen binding site that bind to anti-EpoR and/or modulate an activity of EpoR also are provided. Also provided are any antibodies that contain conservative amino acid changes in their sequence compared to any of the antibodies provided herein.

Provided herein is an anti-ErbB2 antibody containing a VH chain encoded by a sequence of nucleotides compiled from a $V_H$, $D_H$ and $J_H$ germline segment and a VL chain encoded by a sequence of nucleotides compiled from a $V_\kappa$ and $J_\kappa$ germline segments. The $V_H$ germline segment is an IGHV4 or an IGHV1 or genes and alleles thereof. the $D_H$ germline segment is an IGHD6 or an IGHD1 or genes and alleles thereof. The $J_H$ germline segment is an IGHJ1 or an IGHJ2 or genes and alleles thereof. The $V_\lambda$ germline segment is a IGKV3 or IGKV4. The $J_\kappa$ is an IGKJ1 or genes and alleles thereof The anti-ErbB2 antibodies provided herein bind ErbB2 and/or modulate an activity of ErbB2.

In some examples, the $V_H$ germline segment is an the $V_H$ germline segment is an IGHV1-46*01, IGHV1-46*02 or an IGHV1-46*03 or an IGHV4-31*01, IGHV4-31*02, IGHV4-31*03, IGHV4-31*04, IGHV4-31*05, IGHV4-31*06, IGHV4-31*07, IGHV4-31*08, IGHV4-31*09, IGHV4-31*10. The $D_H$ germline segment is an IGHD6-6*01 or IGHD1-26*01. The $J_H$ germline segment is an IGHJ1*01 or an IGHJ2*01. The $V_\kappa$ germline segment is an IGHV3-20*01, IGHV3-20*02 or IGKV4-1*01. The $J_\kappa$ germline segment that is a IGKJ1*01. For example, the anti-ErbB2 antibody provided herein a VH chain encoded by a sequence of nucleotides compiled from an IGHV4-31*02, IGHD1-26*01 and IGHJ2*01 and a VL chain encoded by a sequence of nucleotides compiled from IGKV3-20*01 and IGKJ1*01 germline segments or contains a VH encoded by a sequence of nucleotides compiled from IGHV1-46*01, IGHD6-6*01 and IGHJ1*01 germline segments and a VL chain encoded by a sequence. Anti-ErbB2 antibodies provided herein include, but are not limited to, an antibody containing a $V_H$ chain having a sequence of amino acids set forth in SEQ ID NO: 1760 and a VL chain having a sequence of amino acids set forth in SEQ ID NO:1833; or a $V_H$ chain having a sequence of amino acids set forth in SEQ ID NO: 1513 and a VL chain having a seqene of amino acids set forth in SEQ ID NO:1838. Antibodies that include portions of any of the above antibodies that form a sufficient antigen binding site that bind to anti-ErbB2 and/or modulate an activity of ErbB2 also are provided. Also provided are any antibodies that contain conservative amino acid changes in their sequence compared to any of the antibodies provided herein.

Any of the antibodies provided herein can further contain a constant region or a portion of a constant region sufficient to permit association of a heavy and light chain. For example, antibodies provided herein include Fab antibodies. In addition, any of the antibodies provided herein include antibodies having a binding affinity that is or is about $10^{-6}M$, $10^{-7}M$, $10^{-8}M$, $10^{-9}M$, $10^{-10}M$, $10^{-11}M$ or $10^{-12}M$ or lower. For example, any of the antibodies provided herein have a binding affinity that is or is about $1\times10^{-9}M$, $2\times10^{-9}M$, $3\times10^{-9}M$, $4\times10^{-9}M$, $5\times10^{-9}M$, $6\times10^{-9}M$, $7\times10^{-9}M$, $8\times10^{-9}M$, $9\times10^{-9}M$, $1\times10^{-10}M$, $2\times10^{-10}M$, $3\times10^{-10}M$, $4\times10^{-10}M$, $5\times10^{-10}M$, $6\times10^{-10}M$, $7\times10^{-10}M$, $8\times10^{-10}M$, $9\times10^{-10}M$ or less.

Provided herein are methods of treatment using any of the antibodies provided herein, including any of the antibodies identified in the screening method provided herein. Such antibodies can be used to treat diseases or disorders associated with expression and/or activity of the target protein. In one example, provided herein are methods of treatment or uses of treating or formulating a medicament with any of the anti-DLL4 antibodies provided herein for treating a disease or disorder associated with expression and/or activity of DLL4. In another example, provided herein are methods of treatment or uses of treating or formulation of a medicament with any of the anti-EpoR antibodies provided herein for treating a disease or disorder associated with expression and/or activity of EpoR. In an additional example, provided herein are methods of treatment using anti-ErbB2 antibodies provided herein for treating a disease or disorder associated with expression and/or activity of ErbB2. Provided herein is a computer system or a computer readable medium that contains computer-readable instructions executable by a computer device for performing a method of combining human germline segments. The method of combinaing human germline segments includes these steps of (a) accessing a user-created in silico database of all available human antibody germline segments ($V_H$, $D_H$, $J_H$, $V_\kappa$, $J_\kappa$, $V_\lambda$ and $J_\lambda$); (b) applying an algorithm to generate a collection of every possible recombined full length nucleic acid sequence encoding a heavy chain (5'-$V_H$-$D_H$-$J_H$-3'); (c) applying an algorithm to generate a collection of every possible recombined full length nucleic acid sequence encoding a kappa light chains (5'-$V_\kappa$-$J_\kappa$-3') and/or every possible recombined full length nucleic acid sequence encoding a lambda light chains (5'$V_\lambda$-$J_\lambda$-3'); (d) applying an algorithm to modify nucleotides at the V-D and/or D-J joints of the nucleic acid sequences of (b) and at the V-J joints of the nucleic acid sequences of (c) so that the resulting nucleic acids sequences are in frame; (e) modifying the nucleic acid sequences of (d) to remove any inadvertently generated stop codons; (f) assigning each recombined nucleic acid sequence to a unique locus of an addressable format; and (g) generating an output file that identifies the address of each recombined nucleic acid sequences. The method executed by the computer system or computer readable medium can further include (h) after step (e) adding nucleotides at the 5' and 3' termini of the recombined nucleic acid sequences containing a sequence recognized by a restriction enzyme; and (i) modifying the recombined nucleic acid sequence by nucleotide replacement to remove internal nucleotides that are recognized by a restriction enzyme. The method can further modify the recombined nucleic acid sequences to optimize codon usage for bacterial expression. In some examples, the method executed by the computer system or computer readable medium can include before step (f) selecting recombined nucleic acid sequence(s) from the library of recombined nucleic acid sequences based on sequence similarities or differences and assigning only the selected sequences to a locus in an addressable format in step f).

Provided herein is a method that includes execution of computer-readable instructions for performing a method of combining human germline segments by a computer device, whereby the method includes the steps of (a) accessing a user-created in silico database of all available human antibody germline segments ($V_H$, $D_H$, $J_H$, $V_\kappa$, $J_\kappa$, $V_\lambda$ and $J_\lambda$); (b) applying an algorithm to generate a collection of every possible recombined full length nucleic acid sequence encoding a heavy chain (5'-$V_H$-$D_H$-$J_H$-3'); (c) applying an algorithm to generate a collection of every possible recombined full length nucleic acid sequence encoding a kappa light chains (5'-$V_\kappa$-$J_\kappa$-3') and/or every possible recombined full length nucleic acid sequence encoding a lambda light chains (5'-$V_\lambda$-$J_\lambda$-3'); (d) applying an algorithm to modify nucleotides at the V-D and/or D-J joints of the nucleic acid sequences of (b) and at the V-J joints of the nucleic acid sequences of (c) so that the resulting nucleic acids sequences are in frame; (e) modifying the nucleic acid sequences of (d) to remove any inadvertently generated stop codons; (f) assigning each recombined nucleic acid sequence to a unique locus of an addressable format; and (g) generating an output file that identifies the address of each recombined nucleic acid sequences. The method further includes DNA synthesis of the recombined nucleic acid sequences encoding a heavy chain, encoding a kappa light chain, and/or encoding a lambda light chain, or DNA synthesis of a subset of recombined nucleic acid sequences encoding a heavy chain, encoding a kappa light chain, and/or encoding a lambda light chain.

BRIEF DESCRIPTION OF THE FIGURES

FIG. 1 illustrates how antibody diversity is generated, including combinatorial diversity, pairing diversity, and junctional diversity.

FIG. 2: Schematic Illustration of Iterative Methods of Antibody Discovery

FIG. 3 is an illustrative vector map of plasmid A, provided and described in detail herein.

FIG. 4 is an illustrative vector map of plasmid D, provided and described in detail herein.

FIG. 5 is an illustrative vector map of plasmid C, provided and described in detail herein.

FIG. 6 is an illustrative vector map of plasmid E, provided and described in detail herein.

FIG. 7 illustrates the 10 modules that are contained within the DNA Sequence Compilation Software. As illustrated, there are four layers, including the GUI (Graphical User Interface), the GUI Controls, the Compilation rules and the NCBI tools. In addition, the associations between the modules are illustrated.

FIG. 8 is a schematic diagram of the algorithm for generating recombined nucleic acid sequences from germline segments encoding a variable heavy chain or a variable light chain.

FIG. 9 is a flow chart for modifying recombined nucleic acid sequences encoding a functional variable heavy chain or a variable light chain.

FIG. 10 is a flow chart for ranking recombined variable heavy and light chains based on diversity score and cluster information.

FIG. 11: Schematic Illustration of Sequence Database File Format

FIG. 11 illustrates the format of the sequence database file. Illustrated are exemplary sequences, including VH1-18 (SEQ ID NO:10), VH1-2 (SEQ ID NO:13), IGHD1-1*01 (SEQ ID NO:239), IGHJ1*01 (SEQ ID NO:273), AI (SEQ ID NO:330), A10 (SEQ ID NO:354), IGKJ1*01 (SEQ ID NO:356), V1-11 (SEQ ID NO:365), V1-13 (SEQ ID NO:366), IGLJ1*01 (SEQ ID NO:442), IGLJ2*01 (SEQ ID NO:443), and Mfe I restriction site (SEQ ID NO:1900).

FIG. 12 depicts the initial startup screen for the DNA Sequence Compilation Software. Illustrated are 5' End sequence CCATGGCA (SEQ ID NO:1901), 5' End sequence CCATGGCG, (SEQ ID NO:1902), 3' End sequence CTAGC (SEQ ID NO:1903) and 3' End sequence GTACT (SEQ ID NO:1904).

FIG. 13 depicts the splash screen that appears upon application startup.

FIG. 14 depicts a model 96-well plate screen containing compiled sequences. The sequence of gnl|Fabrus|V3-4_IGLJ7*01 (SEQ ID NO:1906) is illustrated in the sequence information box.

FIG. 15: DNA Sequence Compilation Software Light Chain Manual Compilation Screen FIG. 15 depicts a model manual compilation screen, which allows the user to compile either a kappa or lambda light chain. Selected in the VL sequence box is V1-11 (SEQ ID NO:365). Selected in the JL sequence box is IGLJ1*01 (SEQ ID NO:442). The full length sequence (SEQ ID NO:1914) is depicted in the Dna sequence box.

FIG. 16 depicts a model manual compilation screen, which allows the user to compile a heavy chain. Selected in the VH sequence box is VH1-18 (SEQ ID NO:10). Selected in the DH sequence box is IGHD1-1*01 (SEQ ID NO:239). Selected in the JH sequence box is IGHJ1*01 (SEQ ID NO:373). The full length sequence (SEQ ID NO:1915) is depicted in the Dna sequence box.

FIG. 17: DNA Sequence Compilation Software Light Chain Auto Compilation Screen

FIG. 17 depicts a model light chain auto compilation screen. Illustrated are exemplary sequences of variable light chains set forth in SEQ ID NOS:1880-1881, 1883, 1905-1913 and 1916-1940.

FIG. 18: Light Chain BLAST Grid

FIG. 18 depicts a model BLAST grid for a light chain sequence. Illustrated are exemplary sequences of variable light chains set forth in SEQ ID NOS:1880-1881, 1883, 1905-1913, 1916-1939.

FIG. 19: DNA Sequence Compilation Software Heavy Chain Auto Compilation Screen

FIG. 19 depicts a model heavy chain auto compilation screen. Illustrated are exemplary sequences of variable heavy chains set forth in SEQ ID NOS:1556, 1760, 1769, 1821, 1941-1973.

FIG. 20: Heavy Chain BLAST Grid

FIG. 20 depicts a model of the BLAST grid for a heavy chain sequence. Illustrated are exemplary sequences of variable heavy chains set forth in SEQ ID NOS:1530, 1539, 1974-1995.

DETAILED DESCRIPTION

Outline

Figure 1:
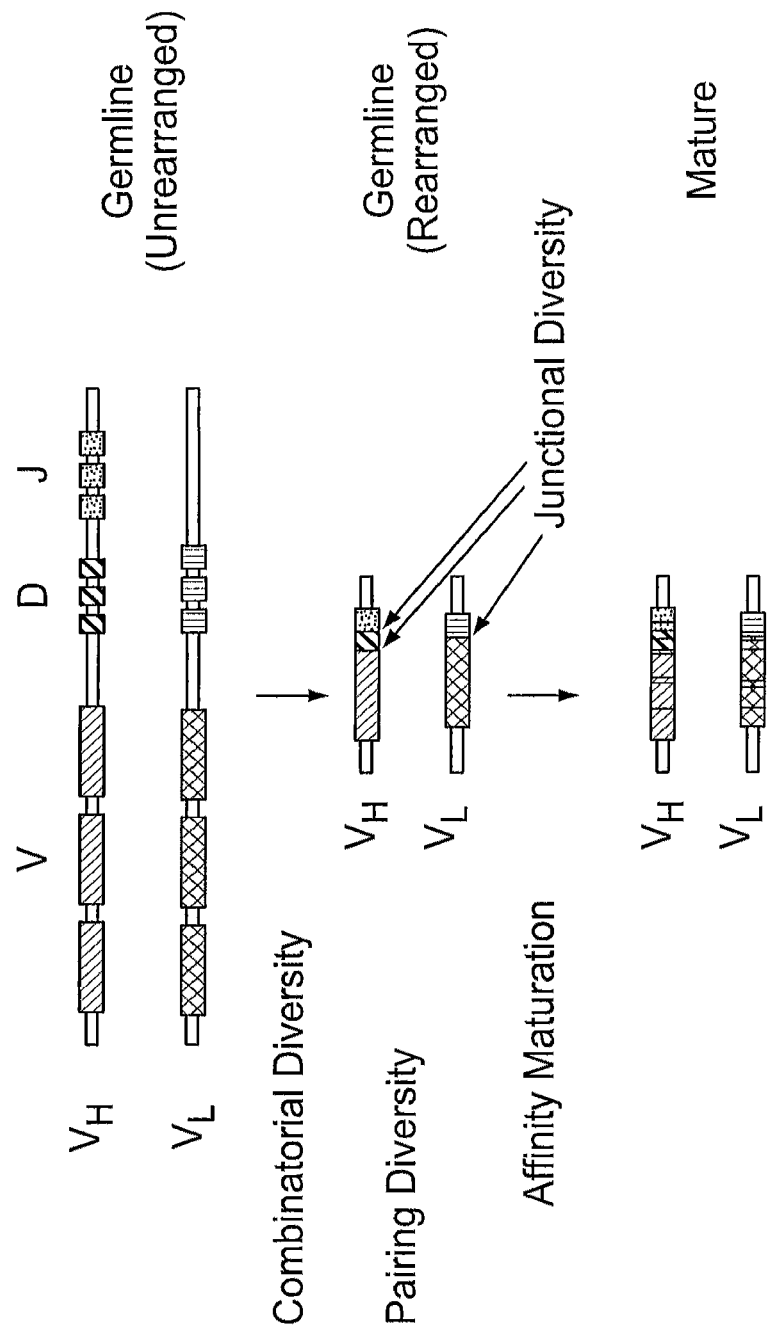
FIG. 1: Schematic Illustration of the Method for Generating Antibody Diversity

A. Definitions
B. Overview
  1. Methods of Generating Addressable Combinatorial Antibody Collections
  2. The Resulting Libraries
  3. Applications of the libraries
C. Antibodies
  1. Antibody Polypeptides
  2. Antibody structural and functional domains
  3. Antibody Sequence and Specificity
D. Methods of Generating Members of the Combinatorial Antibody Library
  1. Methods for Producing Functional Recombined Germline Variable Region
    a. Variable Gene Segments
      i. Germline Segments
      ii. Modified Germline Segments
    b. Choosing Germline Segments or Modified Segments Thereof
    c. Sequence Compilation
    d. Further Sequence Modification of Recombined Nucleic Acid Molecules
      i. Codon Usage
      ii. Adding or Removing Restriction Enzyme Sites
      iii. Linkers
      iv. Tags or detectable moieties
      v. Mutational Diversity
      vi. Directed Peptides
    e. Generating Variable Heavy and Light Chain Sequences and Nucleic Acid Molecules
      i. Storage and Collection
      ii. Determining Sequence Diversity of Collected Nucleic Acid Sequences
      iii. Generating Nucleic Acid Molecules
        a) Synthesis
        b) Recombinant Techniques
    f. Expressing and Producing Antibodies or Portions or Fragments Thereof Resulting Members in the Library
  2. Automation
    a. User-Created Database
    b. Sequence Compilation
    c. Automation of protein expression and purification
E. Libraries
  1. $V_H$ nucleic Acid Libraries and Vector Libraries Thereof
  2. VL nucleic acid Libraries and Vector Libraries Thereof
  3. Paired Nucleic Acid Libraries or Vector Libraries Thereof
  4. Antibody Libraries
  5. Addressable Formats
    a. Multiwell Plate
    b. Solid Support
  6. Other Display Methods
    a. Cell Display
    b. Phage Display
    c. mRNA Display and Ribosome Display
    d. DNA display
F. Methods of Production of Antibodies
  1. Vectors
  2. Cells Expression Systems
    a. Prokaryotic Expression
    b. Yeast
    c. Insects
    d. Mammalian Cells
    e. Plants
  3. Purification
G. Application and Uses of the libraries
  1. Binding Assays
  2. Functional Activity
    a. Differentiation
    b. Alternation of Gene Expression
    c. Cytotoxicity Activity 3. Targets
   Membrane-bound proteins, receptors and ligands thereof
   i. Notch and Notch ligands
      a) Notch Proteins
      b) DLL4
   ii. ErbB family
      a) Epidermal Growth Factor Receptor (EGFR)
      b) Human Epidermal Growth Factor Receptor 2 (HER2/neu)
      iii. IGF-R1 (Insulin-like Growth Factor 1 Receptor)
      iv. c-Met
      v. CD20-B lymphocyte antigen
      vii. Erythropoietin Receptor (Epo-R)
      viii. Cadherins
         a) P-Cadherin (P-cad/CDH3)
      ix. CD44
4. Iterative Screening
5. Directed Evolution
   a. Random Mutagenesis
      i. Saturation Mutagenesis
      ii. Error Prone PCR
      iii. Cell lines
      iv. DNA shuffling/antibody chain shuffling
      v. CDR walking
      vi. Framework Stabilization
6. Epitope Mapping
7. In Vivo Assays of Identified Hits
8. Articles of Manufacture/Kits
9. Formulations/Administrations and uses of antibodies and polypeptides H. Examples A. Definitions Unless defined otherwise, all technical and scientific terms used herein have the same meaning as is commonly understood by one of skill in the art to which the invention(s) belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, "combinatorial library" refers to collections of compounds formed by reacting different combinations of interchangeable chemical "building blocks" to produce a collection of compounds based on permutations of the building blocks. For an antibody combinatorial library, the building blocks are the component V, D and J regions (or modified forms thereof) from which antibodies are formed. For purposes herein, the terms "library" or "collection" are used interchangeably.

As used herein, a combinatorial antibody library is a collection of antibodies (or portions thereof, such as Fabs), where the antibodies are encoded by nucleic acid molecules produced by the combination of V, D and J gene segments, particularly human V, D and J germline segments. The combinatorial libraries herein typically contain at least 50 different antibody (or antibody portions or fragment) members, typically at or about 50, 100, 500, $10^3$, $2\times10^3$, $3\times10^3$, $4\times10^3$, $5\times10^3$, $6\times10^3$, $7\times10^3$, $8\times10^3$, $9\times10^3$, $1\times10^3$, $2\times10^4$, $3\times10^4$, $4\times10^4$, $5\times10^4$, $6\times10^4$, $7\times10^4$, $8\times10^4$, $9\times10^4$, $1\times10^5$, $2\times10^5$, $3\times10^5$, $4\times10^5$, $5\times10^5$, $6\times10^5$, $7\times10^5$, $8\times10^5$, $9\times10^5$, $10^6$, $10^7$, $10^8$, $10^9$, $10^{10}$, or more different members. The resulting libraries or collections of antibodies or portions thereof, can be screened for binding to a target protein or modulation of a functional activity.

As used herein, a human combinatorial antibody library is a collection of antibodies or portions thereof, whereby each member contains a VL and $V_H$ chains or a sufficient portion thereof to form an antigen binding site encoded by nucleic acid containing human germline segments produced as described herein.

As used herein, germline gene segments refer to immunoglobulin (Ig) variable (V), diversity (D) and junction (J) or constant (C) genes from the germline that encode immunoglobulin heavy or light (kappa and lambda) chains. There are multiple V, D, J and C gene segments in the germline, but gene rearrangement results in only one segment of each occurring in each functional rearranged gene. For example, a functionally rearranged heavy chain contains one V, one D and one J and a functionally rearranged light chain gene contains one V and one J. Hence, these gene segments are carried in the germ cells but cannot be transcribed and translated into heavy and light chains until they are arranged into functional genes. During B-cell differentiation in the bone marrow, these gene segments are randomly shuffled by a dynamic genetic system capable of generating more than $10^{10}$ specificities. For purposes herein, the gene segments are rearranged in vitro by combination or compilation of the individual germline segments.

Reference to a variable germline segment herein refers to V, D and J groups, subgroups, genes or alleles thereof. Gene segment sequences are accessible from known database (e.g., National Center for Biotechnology Information (NCBI), the international ImMunoGeneTics information system® (IMGT), the Kabat database and the Tomlinson's VBase database (Lefranc (2003) *Nucleic Acids Res.*, 31:307-310; Martin et al., Bioinformatics Tools for Antibody Engineering in Handbook of Therapeutic Antibodies, Wiley-VCH (2007), pp. 104-107). Tables 3-5 list exemplary human variable germline segments. Sequences of exemplary $V_H$, $D_H$, $J_H$, $V_\kappa$, $J_\kappa$, $V_\lambda$ and or $J_\lambda$, germline segments are set forth in SEQ ID NOS: 10-451 and 868. For purposes herein, a germline segment includes modified sequences thereof, that are modified in accord with the rules of sequence compilation provided herein to permit practice of the method. For example, germline gene segments include those that contain one amino acid deletion or insertion at the 5' or 3' end compared to any of the sequences of nucleotides set forth in SEQ ID NOS:10-451, 868.

As used herein, modified form with reference to a germline segment refers to a sequence of nucleotides that is substantially the same as the sequence of nucleotides of a human germline segment (e.g. a $V_H$, $D_H$, $J_H$, $V_\kappa$, $J_\kappa$, $V_\lambda$ and $J_\lambda$) except that the sequence of nucleotides contains one or a few nucleotide differences, for example, 2, 3, 4, 5, 6, 7, 8, 9 or 10 nucleotide differences compared to the corresponding sequence in a germline segment sequence. In some instances, modified germline sequences are modified in accord with the rules herein to remove stop codons, restriction enzyme sites, or to add or delete nucleotides to maintain reading frames.

As used herein, inverted sequence with reference to nucleotides of a germline segment means that the gene segment has a sequence of nucleotides that is the reverse complement of a reference sequence of nucleotides. For purposes herein, the reference sequence of nucleotides is a germline segment, typically a $D_H$ germline segment.

As used herein, "compilation," "compile," "combine," "combination," "rearrange," "rearrangement," or other similar terms or grammatical variations thereof refers to the process by which germline segments are ordered or assembled into nucleic acid sequences representing genes. For example, variable heavy chain germline segments are assembled such that the $V_H$ segment is 5' to the $D_H$ segment which is 5' to the $J_H$ segment, thereby resulting in a nucleic acid sequence encoding a $V_H$ chain. Variable light chain germline segments are assembled such that the $V_L$ segment is 5' to the JL segment, thereby resulting in a nucleic acid sequence encoding a VL chain. A constant gene segment or segments also can be assembled onto the 3' end of a nucleic acid encoding a $V_H$ or VL chain.

As used herein, "linked," or "linkage" or other grammatical variations thereof with reference to germline segments refers to the joining of germline segments. Linkage can be direct or indirect. Germline segments can be linked directly without additional nucleotides between segments, or additional nucleotides can be added to render the entire segment in-frame, or nucleotides can be deleted to render the resulting segment in-frame. It is understood that the choice of linker nucleotides is made such that the resulting nucleic acid molecule is in-frame and encodes a functional and productive antibody.

As used herein, "in-frame" or "linked in-frame" with reference to linkage of human germline segments means that there are insertions and/or deletions in the nucleotide germline segments at the joined junctions to render the resulting nucleic acid molecule in-frame with the 5' start codon (ATG), thereby producing a "productive" or functional full-length polypeptide. The choice of nucleotides inserted or deleted from germline segments, particularly at joints joining various VD, DJ and VJ segments, is in accord with the rules provided in the method herein for V(D)J joint generation. For example, germline segments are assembled such that the $V_H$ segment is 5' to the $D_H$ segment which is 5' to the $J_H$ segment. At the junction joining the $V_H$ and the $D_H$ and at the junction joining the $D_H$ and $J_H$ segments, nucleotides can be inserted or deleted from the individual $V_H$, $D_H$ or $J_H$ segments, such that the resulting nucleic acid molecule containing the joined VDJ segments are in-frame with the 5' start codon (ATG).

As used herein, a "functional antibody" or "productive antibody" with reference to a nucleic acid encoding an antibody or portion thereof refers to an antibody or portion thereof, such as Fab, that is encoded by the nucleic acid molecule produced by the methods as described herein. In a functional or productive antibody, the V(D)J germline segments are compiled (i.e. rearranged) such that the encoded antibody or portion thereof is not truncated and/or the amino acid sequence is not out of frame. This means that the nucleic acid molecule does not contain internal stop codons that result in the protein translation machinery terminating protein assembly prematurely.

As used herein, a portion of an antibody includes sufficient amino acids to form an antigen binding site.

As used herein, a reading frame refers to a contiguous and non-overlapping set of three-nucleotide codons in DNA or RNA. Because three codons encode one amino acid, there exist three possible reading frames for given nucleotide sequence, reading frames 1, 2 or 3. For example, the sequence ACTGGTCA will be ACT GGT CA for reading frame 1, A CTG GTC A for reading frame 2 and AC TGG TCA for reading frame 3. Generally for practice of the method described herein, nucleic acid sequences are combined so that the V sequence has reading frame 1.

As used herein, a stop codon is used to refer to a three-nucleotide sequence that signals a halt in protein synthesis during translation, or any sequence encoding that sequence (e.g. a DNA sequence encoding an RNA stop codon sequence), including the amber stop codon (UAG or TAG)), the ochre stop codon (UAA or TAA)) and the opal stop codon (UGA or TGA)). It is not necessary that the stop codon signal termination of translation in every cell or in every organism. For example, in suppressor strain host cells, such as amber suppressor strains and partial amber suppressor strains, translation proceeds through one or more stop codon (e.g. the amber stop codon for an amber suppressor strain), at least some of the time.

As used herein, reference to a variable heavy (VH) chain or a variable light (VL) chain (also termed VH domain or VL domain) refers to the polypeptide chains that make up the variable domain of an antibody. For purposes herein, heavy chain germline segments are designated as $V_H$, $D_H$ and $J_H$, and compilation thereof results in a nucleic acid encoding a VH chain. Light chain germline segments are designated as $V_L$ or $J_L$, and include kappa and lambda light chains ($V_\kappa$ and $J_\kappa$; $V_\lambda$ and $J_\lambda$) and compilation thereof results in a nucleic acid encoding a VL chain. It is understood that a light chain chain is either a kappa or lambda light chain, but does not include a kappa/lambda combination by virtue of compilation of a $V_\kappa$ and $J_\lambda$.

As used herein, a "degenerate codon" refers to three-nucleotide codons that specifies the same amino acid as a codon in a parent nucleotide sequence. One of skill in the art is familiar with degeneracy of the genetic code and can identify degenerate codons.

As used herein, a "group" with reference to a germline segment refers to a core coding region from an immunoglobulin, i.e. a variable (V) gene, diversity (D) gene, joining (J) gene or constant (C) gene encoding a heavy or light chain. Exemplary of germline segment groups include $V_H$, $D_H$, $J_H$, $V_\kappa$, $J_\kappa$, $V_\lambda$ and $J_\lambda$.

As used herein, a "subgroup" with reference to a germline segment refers to a set of sequences that are defined by nucleotide sequence similarity or identity. Generally, a subgroup is a set of genes that belong to the same group [V, D, J or C], in a given species, and that share at least 75% identity at the nucleotide level. Subgroups are classified based on IMGT nomenclature (imgt.cines.fr; see e.g., Lefranc et al. (2008) Briefings in Bioinformatics, 9:263-275). Generally, a subgroup represent a multigene family.

As used herein, an allele of a gene refer to germline sequences that have sequence polymorphism due to one or more nucleotide differences in the coding region compared to a reference gene sequence (e.g. substitutions, insertions or deletions). Thus, IG sequences that belong to the same subgroup can be highly similar in their coding sequence, but nonetheless exhibit high polymorphism. Subgroup alleles are classified based on IMGT nomenclature with an asterisk(*) followed by a two figure number. Exemplary allelic subgroup germline segments for $V_H$, $D_H$, $J_H$, $V_\kappa$, $J_\kappa$, $V_\lambda$ and $J_\lambda$ are set forth in Tables 3-5.

As used herein, a "family" with reference to a germline segment refers to sets of germline segment sequences that are defined by amino acid sequence similarity or identity. Generally, a germline family includes all alleles of a gene.

As used herein, a "segment designated $D_H$" refers to any sequence of nucleotides of at least or about 10, 11, 12, 13, 14, 15, 16, 17, 18, 19, 20, 30, 40, 50, 60, 70, 80, 90 or 100 nucleotides in length. The sequence of nucleotides is sufficient to code for part of the CDR3 region of the $V_H$ chain.

As used herein, reference to a V, D or J gene segment "derived from a germline segment" refers to the corresponding nucleotides in a VH or VL nucleic acid sequence, that by recombination events, derived from a V, D or J germline gene.

As used herein, reference to a V region, D region or J region in an antibody or portion or fragment thereof refers to amino acids encoded by nucleotides that, by recombination events, derive from a corresponding V, D or J germline segment gene.

As used herein, "diversity" with respect to members in a collection refers to the number of unique members in a collection. Hence, diversity refers to the number of different amino acid sequences or nucleic acid sequences, respectively, among the analogous polypeptide members of that collection. For example, a collection of polynucleotides having a diversity of $10^4$ contains $10^4$ different nucleic acid sequences among the analogous polynucleotide members. In one example, the provided collections of polynucleotides and/or polypeptides have diversities of at least at or about $10^2$, $10^3$, $10^4$, $10^5$, $10^6$, $10^7$, $10^8$, $10^9$, $10^{10}$ or more.

As used herein, "a diversity ratio" refers to a ratio of the number of different members in the library over the number of total members of the library. Thus, a library with a larger diversity ratio than another library contains more different members per total members, and thus more diversity per total members. The provided libraries include libraries having high diversity ratios, such as diversity ratios approaching 1, such as, for example, at or about 0.1, 0.2, 0.3, 0.4, 0.5, 0.6, 0.7, 0.8, 0.9, 0.91, 0.92, 0.93, 0.94, 0.95, 0.96, 0.97, 0.98, or 0.99.

As used herein, "sequence diversity" refers to a representation of nucleic acid sequence similarity and is determined using sequence alignments, diversity scores, and/or sequence clustering. Any two sequences can be aligned by laying the sequences side-by-side and analyzing differences within nucleotides at every position along the length of the sequences. Sequence alignment can be assessed in silico using Basic Local Alignment Search Tool (BLAST), an NCBI tool for comparing nucleic acid and/or protein sequences. The use of BLAST for sequence alignment is well known to one of skill in the art. The Blast search algorithm compares two sequences and calculates the statistical significance of each match (a Blast score). Sequences that are most similar to each other will have a high Blast score, whereas sequences that are most varied will have a low Blast score.

As used herein, antibody refers to immunoglobulins and immunoglobulin portions, whether natural or partially or wholly synthetic, such as recombinantly, produced, including any portion thereof containing at least a portion of the variable region of the immunoglobulin molecule that is sufficient to form an antigen binding site. Hence, an antibody or portion thereof includes any protein having a binding domain that is homologous or substantially homologous to an immunoglobulin antigen binding site. For example, an antibody refers to an antibody that contains two heavy chains (which can be denoted H and H') and two light chains (which can be denoted L and L'), where each heavy chain can be a full-length immunoglobulin heavy chain or a portion thereof sufficient to form an antigen binding site (e.g. heavy chains include, but are not limited to, VH, chains VH-CH1 chains and VH-CH1-CH2-CH3 chains), and each light chain can be a full-length light chain or a portion thereof sufficient to form an antigen binding site (e.g. light chains include, but are not limited to, VL chains and VL-CL chains). Each heavy chain (H and H') pairs with one light chain (L and L', respectively). Typically, antibodies minimally include all or at least a portion of the variable heavy ($V_H$) chain and/or the variable light (VL) chain. The antibody also can include all or a portion of the constant region.

For purposes herein, the term antibody includes full-length antibodies and portions thereof including antibody fragments, such as, but not limited to, Fab, Fab', F(ab')$_2$, single-chain Fvs (scFv), Fv, dsFv, diabody, Fd and Fd' fragments Fab fragments, Fd fragments and scFv fragments. Other known fragments include, but are not limited to, scFab fragments (Hust et al., *BMC Biotechnology* (2007), 7:14). Antibodies include members of any immunoglobulin class, including IgG, IgM, IgA, IgD and IgE.

As used herein, a full-length antibody is an antibody having two full-length heavy chains (e.g. $V_H$-CH1-CH2-CH3 or $V_H$-CH1-CH2-CH3-CH4) and two full-length light chains (VL-CL) and hinge regions, such as human antibodies produced by antibody secreting B cells and antibodies with the same domains that are produced synthetically.

As used herein, antibody fragment or antibody portion refers to any portion of a full-length antibody that is less than full length but contains at least a portion of the variable region of the antibody sufficient to form an antigen binding site (e.g. one or more CDRs) and thus retains the a binding specificity and/or an activity of the full-length antibody; antibody fragments include antibody derivatives produced by enzymatic treatment of full-length antibodies, as well as synthetically, e.g. recombinantly produced derivatives. Examples of antibody fragments include, but are not limited to, Fab, Fab', F(ab')$_2$, single-chain Fvs (scFv), Fv, dsFv, diabody, Fd and Fd' fragments (see, for example, *Methods in Molecular Biology*, Vol 207: *Recombinant Antibodies for Cancer Therapy Methods and Protocols* (2003); Chapter 1; p 3-25, Kipriyanov). The fragment can include multiple chains linked together, such as by disulfide bridges and/or by peptide linkers. An antibody fragment generally contains at least about 50 amino acids and typically at least 200 amino acids.

As used herein, an Fv antibody fragment is composed of one variable heavy domain (VH) and one variable light (VL) domain linked by noncovalent interactions.

As used herein, a dsFv refers to an Fv with an engineered intermolecular disulfide bond, which stabilizes the VH-VL pair.

As used herein, an Fd fragment is a fragment of an antibody containing a variable domain (VH) and one constant region domain (CH1) of an antibody heavy chain.

As used herein, "Fab fragment" is an antibody fragment that contains the portion of the full-length antibody that results from digestion of a full-length immunoglobulin with papain, or a fragment having the same structure that is produced synthetically, e.g. recombinantly. A Fab fragment contains a light chain (containing a VL and CL portion) and another chain containing a variable domain of a heavy chain (VH) and one constant region domain portion of the heavy chain (CH1); it can be recombinantly produced.

As used herein, a F(ab')$_2$ fragment is an antibody fragment that results from digestion of an immunoglobulin with pepsin at pH 4.0-4.5, or a synthetically, e.g. recombinantly, produced antibody having the same structure. The F(ab')2 fragment contains two Fab fragments but where each heavy chain portion contains an additional few amino acids, including cysteine residues that form disulfide linkages joining the two fragments; it can be recombinantly produced.

A Fab' fragment is a fragment containing one half (one heavy chain and one light chain) of the F(ab')$_2$ fragment.

As used herein, an Fd' fragment is a fragment of an antibody containing one heavy chain portion of a F(ab')2 fragment.

As used herein, an Fv' fragment is a fragment containing only the $V_H$ and $V_L$ domains of an antibody molecule.

As used herein, a scFv fragment refers to an antibody fragment that contains a variable light chain (VL) and variable heavy chain (VH), covalently connected by a polypeptide linker in any order. The linker is of a length such that the two variable domains are bridged without substantial interference. Exemplary linkers are (Gly-Ser)$_n$ residues with some Glu or Lys residues dispersed throughout to increase solubility.

As used herein, diabodies are dimeric scFv; diabodies typically have shorter peptide linkers than scFvs, and they preferentially dimerize.

As used herein, hsFv refers to antibody fragments in which the constant domains normally present in a Fab fragment have been substituted with a heterodimeric coiled-coil domain (see, e.g., Arndt et al. (2001) *J Mol Biol.* 7:312:221-228).

As used herein, a polypeptide domain is a part of a polypeptide (a sequence of three or more, generally 5 or 7 or more amino acids) that is a structurally and/or functionally distinguishable or definable. Exemplary of a polypeptide domain is a part of the polypeptide that can form an independently folded structure within a polypeptide made up of one or more structural motifs (e.g. combinations of alpha helices and/or beta strands connected by loop regions) and/or that is recognized by a particular functional activity, such as enzymatic activity or antigen binding. A polypeptide can have one, typically more than one, distinct domains. For example, the polypeptide can have one or more structural domains and one or more functional domains. A single polypeptide domain can be distinguished based on structure and function. A domain can encompass a contiguous linear sequence of amino acids. Alternatively, a domain can encompass a plurality of non-contiguous amino acid portions, which are non-contiguous along the linear sequence of amino acids of the polypeptide. Typically, a polypeptide contains a plurality of domains. For example, each heavy chain and each light chain of an antibody molecule contains a plurality of immunoglobulin (Ig) domains, each about 110 amino acids in length.

As used herein, an Ig domain is a domain, recognized as such by those in the art, that is distinguished by a structure, called the Immunoglobulin (Ig) fold, which contains two beta-pleated sheets, each containing anti-parallel beta strands of amino acids connected by loops. The two beta sheets in the Ig fold are sandwiched together by hydrophobic interactions and a conserved intra-chain disulfide bond. Individual immunoglobulin domains within an antibody chain further can be distinguished based on function. For example, a light chain contains one variable region domain (VL) and one constant region domain (CL), while a heavy chain contains one variable region domain (VH) and three or four constant region domains (CH). Each VL, CL, VH, and CH domain is an example of an immunoglobulin domain.

As used herein, a "variable domain" with reference to an antibody is a specific Ig domain of an antibody heavy or light chain that contains a sequence of amino acids that varies among different antibodies. Each light chain and each heavy chain has one variable region domain (VL, and, VH). The variable domains provide antigen specificity, and thus are responsible for antigen recognition. Each variable region contains CDRs that are part of the antigen binding site domain and framework regions (FRs).

As used herein, "hypervariable region," "HV," "complementarity-determining region" and "CDR" and "antibody CDR" are used interchangeably to refer to one of a plurality of portions within each variable region that together form an antigen binding site of an antibody. Each variable region domain contains three CDRs, named CDR1, CDR2, and CDR3. The three CDRs are non-contiguous along the linear amino acid sequence, but are proximate in the folded polypeptide. The CDRs are located within the loops that join the parallel strands of the beta sheets of the variable domain.

As used herein, framework regions (FRs) are the domains within the antibody variable region domains that are located within the beta sheets; the FR regions are comparatively more conserved, in terms of their amino acid sequences, than the hypervariable regions.

As used herein, a constant region domain is a domain in an antibody heavy or light chain that contains a sequence of amino acids that is comparatively more conserved among antibodies than the variable region domain. Each light chain has a single light chain constant region (CL) domain and each heavy chain contains one or more heavy chain constant region (CH) domains, which include, CH1, CH2, CH3 and CH4. Full-length IgA, IgD and IgG isotypes contain CH1, CH2 CH3 and a hinge region, while IgE and IgM contain CH1, CH2 CH3 and CH4. CH1 and CL domains extend the Fab arm of the antibody molecule, thus contributing to the interaction with antigen and rotation of the antibody arms. Antibody constant regions can serve effector functions, such as, but not limited to, clearance of antigens, pathogens and toxins to which the antibody specifically binds, e.g. through interactions with various cells, biomolecules and tissues.

As used herein, humanized antibodies refer to antibodies that are modified to include "human" sequences of amino acids so that administration to a human does not provoke an immune response. Methods for preparation of such antibodies are known. For example, the antibody in which the amino acid composition of the non-variable regions can be based on human antibodies. Computer programs have been designed to identify such regions.

As used herein, "antigen-binding site" refers to the interface formed by one or more complementary determining regions (CDRs; also called hypervariable region). Each antigen binding site contains three CDRs from the heavy chain variable region and three CDRs from the light chain variable region. An antibody molecule has two antigen combining sites, each containing portions of a heavy chain variable region and portions of a light chain variable region. The antigen combining sites can contain other portions of the variable region domains in addition to the CDRs.

As used herein, reference to an "antibody or portion thereof that is sufficient to form an antigen binding site" means that the antibody or portion thereof contains at least 1 or 2, typically 3, 4, 5 or all 6 CDRs of the VH and VL sufficient to retain at least a portion of the binding specificity of the corresponding full-length antibody containing all 6 CDRs. Generally, a sufficient antigen binding site at least requires CDR3 of the heavy chain (CDRH3). It typically further requires the CDR3 of the light chain (CDRL3). As described herein, one of skill in the art knows and can identify the CDRs based on kabat or Chothia numbering (see e.g., Kabat, E. A. et al. (1991) *Sequences of Proteins of Immunological Interest*, Fifth Edition, U.S. Department of Health and Human Services, NIH Publication No. 91-3242, and Chothia, C. et al. (1987) *J. Mol. Biol.* 196:901-917). For example, based on Kabat numbering, CDR-L1 corresponds to residues L24-L34; CDR-L2 corresponds to residues L50-L56; CDR-L3 corresponds to residues L89-L97; CDR-H1 corresponds to residues H31-H35, 35a or 35b depending on the length; CDR-H2 corresponds to residues H50-H65; and CDR-H3 corresponds to residues H95-H 102.

As used herein, a "peptide mimetic" is a peptide that mimics the activity of a polypeptide. For example, an erythropoietin (EPO) peptide mimetic is a peptide that mimics the activity of Epo, such as for binding and activation of the EPO receptor.

As used herein, an optimized antibody refers to an antibody, or portion thereof, that has an improved binding affinity for a target protein and/or an improved functional activity compared to a reference antibody. Typically, the antibody is optimized by virtue of one or more amino acid modifications (amino acid deletion, replacement or insertion) compared to a parent antibody not containing the one or more amino acid modifications. Generally, an activity or binding affinity is increased by at or about 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1000-fold or more compared to an activity or binding affininity of the parent antibody (e.g. germline Hit not containing the modification(s)).

As used herein, corresponding with reference to corresponding residues, for example "amino acid residues corresponding to", referes to residues compared among or between two polypeptides that are related sequences (e.g. allelic variants, genes of the same family, species variants). One of skill in the art can readily identify residues that correspond between or among polypeptides. For example, by aligning the sequence of regions encoded by germline segments, one of skill in the art can identify corresponding residues, using conserved and identical amino acids as guides. One of skill in the art can manually align a sequence or can use any of the numerous alignment programs available (for example, BLAST). Hence, an amino acid residues or positions that correspond to each other are those residues that are determined to correspond to one another based on sequence and/or structural alignments with a specified reference polypeptide.

As used herein, a consensus sequence is a sequence containing residues that are the most frequently occurring residues at each position when a plurality of related sequences (e.g. allelic variants, genes of the same family, species variants) are aligned. Hence a consensus sequence represents the residues that are the most abundant in the alignment at each position. For purposes herein, for example, germline sequences, or portions thereof, can be aligned to generate a consensus germline sequence.

As used herein, a locus in a library refers to a location or position, that can contain a member or members of library. The position does not have to be a physical position. For example, if the collection is provided as an array on a solid support, the support contains loci that can or do present members of the array.

As used herein, an address refers to a unique identifier for each locus in a collection whereby an addressed member (e.g. an antibody) can be identified. An addressed moiety is one that can be identified by virtue of its locus or location. Addressing can be effected by position on a surface, such as a well of a microplate. For example, an address for a protein in a microwell plate that is F9 means that the protein is located in row F, column 9 of the microwell plate. Addressing also can be effected by other identifiers, such as a tag encoded with a bar code or other symbology, a chemical tag, an electronic, such RF tag, a color-coded tag or other such identifier.

As used herein, an array refers to a collection of elements, such as antibodies, containing three or more members.

As used herein, a "spatial array" is an array where members are separated or occupy a distinct space in an array. Hence, spatial arrays are a type of addressable array. Examples of spatial arrays include microtiter plates where each well of a plate is an address in the array. Spacial arrays include any arrangement wherein a plurality of different molecules, e.g., polypeptides, are held, presented, positioned, situated, or supported. Arrays can include microtiter plates, such as 48-well, 96-well, 144-well, 192-well, 240-well, 288-well, 336-well, 384-well, 432-well, 480-well, 576-well, 672-well, 768-well, 864-well, 960-well, 1056-well, 1152-well, 1248-well, 1344-well, 1440-well, or 1536-well plates, tubes, slides, chips, flasks, or any other suitable laboratory apparatus. Furthermore, arrays can also include a plurality of sub-arrays. A plurality of sub-arrays encompasses an array where more than one arrangement is used to position the polypeptides. For example, multiple 96-well plates can constitute a plurality of sub-arrays and a single array.

As used herein, an addressable library is a collection of molecules such as nucleic acid molecules or protein agents, such as antibodies, in which each member of the collection is identifiable by virtue of its address.

As used herein, an addressable array is one in which the members of the array are identifiable by their address, the position in a spatial array, such as a well of a microtiter plate, or on a solid phase support, or by virtue of an identifiable or detectable label, such as by color, fluorescence, electronic signal (i.e. RF, microwave or other frequency that does not substantially alter the interaction of the molecules of interest), bar code or other symbology, chemical or other such label. Hence, in general the members of the array are located at identifiable loci on the surface of a solid phase or directly or indirectly linked to or otherwise associated with the identifiable label, such as affixed to a microsphere or other particulate support (herein referred to as beads) and suspended in solution or spread out on a surface.

As used herein, "an addressable combinatorial antibody library" refers to a collection of antibodies in which member antibodies are identifiable and all antibodies with the same identifier, such as position in a spatial array or on a solid support, or a chemical or RF tag, bind to the same antigen, and generally are substantially the same in amino acid sequence. For purposes herein, reference to an "addressable arrayed combinatorial antibody library" means that the antibody members are addressed in an array.

As used herein, a support (also referred to as a matrix support, a matrix, an insoluble support or solid support) refers to any solid or semisolid or insoluble support to which a molecule of interest, typically a biological molecule, organic molecule or biospecific ligand is linked or contacted. Such materials include any materials that are used as affinity matrices or supports for chemical and biological molecule syntheses and analyses, such as, but are not limited to: polystyrene, polycarbonate, polypropylene, nylon, glass, dextran, chitin, sand, pumice, agarose, polysaccharides, dendrimers, buckyballs, polyacrylamide, silicon, rubber, and other materials used as supports for solid phase syntheses, affinity separations and purifications, hybridization reactions, immunoassays and other such applications. The matrix herein can be particulate or can be in the form of a continuous surface, such as a microtiter dish or well, a glass slide, a silicon chip, a nitrocellulose sheet, nylon mesh, or other such materials. When particulate, typically the particles have at least one dimension in the 5-10 mm range or smaller. Such particles, referred collectively herein as "beads", are often, but not necessarily, spherical. Such reference, however, does not constrain the geometry of the matrix, which can be any shape, including random shapes, needles, fibers, and elongated. Roughly spherical "beads", particularly microspheres that can be used in the liquid phase, also are contemplated. The "beads" can include additional components, such as magnetic or paramagnetic particles (see, e.g., Dynabeads® (Dynal, Oslo, Norway)) for separation using magnets, as long as the additional components do not interfere with the methods and analyses herein.

As used herein, matrix or support particles refers to matrix materials that are in the form of discrete particles. The particles have any shape and dimensions, but typically have at least one dimension that is 100 mm or less, 50 mm or less, 10 mm or less, 1 mm or less, 100 μm or less, 50 μm or less and typically have a size that is 100 mm$^3$ or less, 50 mm$^3$ or less, 10 mm$^3$ or less, and 1 mm$^3$ or less, 100 μmm$^3$ or less and can be on the order of cubic microns. Such particles are collectively called "beads."

As used herein, in silico refers to research and experiments performed using a computer. In silico methods include, but are not limited to, molecular modeling studies, biomolecular docking experiments, and virtual representations of molecular structures and/or processes, such as molecular interactions. For purposes herein, the antibody members of a library can be designed using a computer program that selects component V, D and J germline segments from among those input into the computer and joins them in-frame to output a list of nucleic acid molecules for synthesis. Thus, the recombination of the components of the antibodies in the collections or libraries provided herein, can be performed in silico by combining the nucleotide sequences of each building block in accord with software that contains rules for doing so. The process can be performed manually without a computer, but the computer provides the convenience of speed.

As used herein, a database refers to a collection of data items. For purposes herein, reference to a database is typically with reference to antibody databases, which provide a collection of sequence and structure information for antibody genes and sequences. Exemplary antibody databases include, but are not limited to, IMGT®, the international ImMunoGeneTics information system (imgt.cines.fr; see e.g., Lefranc et al. (2008) Briefings in Bioinformatics, 9:263-275), National Center for Biotechnology Information (NCBI), the Kabat database and the Tomlinson's VBase database (Lefranc (2003) Nucleic Acids Res., 31:307-310; Martin et al., Bioinformatics Tools for Antibody Engineering in Handbook of Therapeutic Antibodies, Wiley-VCH (2007), pp. 104-107). A database also can be created by a user to include any desired sequences. The database can be created such that the sequences are inputted in a desired format (e.g., in a particular reading frame; lacking stop codons; lacking signal sequences). The database also can be created to include sequences in addition to antibody sequences.

As used herein, "a computer-based system" refers to the hardware, software, and data storage media and methods used to recombine germline segments. The minimum hardware of the computer-based systems provided herein include a central processing unit (CPU), input mean, output means and data storage means. A skilled artisan can select a suitable computer-based systems for use in the methods and systems provided herein.

As used herein, "recorded" refers to a process for storing information on computer readable medium. A skilled artisan can readily adopt any of the presently known methods for recording information on computer readable medium to array image data. The choice of the data storage structure can generally be based on the media and platforms chosen to access the stored information. In addition, a variety of data processor programs and formats can be used to store the array image information on computer readable medium. The image information can be represented in a word processing text file, formatted in commercially-available software such as MICROSOFT Word®, graphics files or represented in the form of an ASCII file, stored in a database application, such as DB2®, Sybase® and Oracle®. A skilled artisan can adapt any number of data processor structuring formats (e.g., text file or database) in order to obtain computer readable medium having recorded thereon the information or instructions as described herein.

As used herein, "screening" refers to identification or selection of an antibody or portion thereof from a collection or library of antibodies and/or portions thereof, based on determination of the activity or property of an antibody or portion thereof. Screening can be performed in any of a variety of ways, including, for example, by assays assessing direct binding (e.g. binding affinity) of the antibody to a target protein or by functional assays assessing modulation of an activity of a target protein.

As used herein, activity towards a target protein refers to binding specificity and/or modulation of a functional activity of a target protein, or other measurements that reflects the activity of an antibody or portion thereof towards a target protein.

As used herein the term assessing is intended to include quantitative and qualitative determination in the sense of obtaining an absolute value for the binding of an antibody or portion thereof with a target protein and/or modulation of an activity of a target protein by an antibody or portion thereof, and also of obtaining an index, ratio, percentage, visual or other value indicative of the level of the binding or activity. Assessment can be direct or indirect. For example, binding can be determined by directly labeling of an antibody or portion thereof with a detectable label and/or by using a secondary antibody that itself is labeled. In addition, functional activities can be determined using any of a variety of assays known to one of skill in the art, for example, proliferation, cytotoxicity and others as described herein, and comparing the activity of the target protein in the presence versus the absence of an antibody or portion thereof.

As used herein, a "target protein" refers to candidate proteins or peptides that are specifically recognized by an antibody or portion thereof and/or whose activity is modulated by an antibody or protion thereof. A target protein includes any peptide or protein that contains an epitope for antibody recognition. Target proteins include proteins involved in the etiology of a disease or disorder by virtue of expression or activity. Exemplary target proteins are described herein.

As used herein, "Hit" refers to an antibody or portion thereof identified, recognized or selected as having an activity in a screening assay.

As used herein, "iterative" with respect to screening means that the screening is repeated a plurality of times, such as 2, 3, 4, 5 or more times, until a "Hit" is identified whose activity is optimized or improved compared to prior iterations.

As used herein, "high-throughput" refers to a large-scale method or process that permits manipulation of large numbers of molecules or compounds, generally tens to hundred to thousands of compounds. For example, methods of purification and screening can be rendered high-throughput. High-throughput methods can be performed manually. Generally, however, high-throughput methods involve automation, robotics or software.

As used herein, "structure/activity relationship (SAR)" refers to the relationship between structure and function of a molecule. For purposes herein, structure is with reference to sequence, for example, a sequence of nucleotides encoding an antibody. By virtue of addressing library members, the identify of each antibody by its sequence is known based on its address. Hence, structure is known and can be correlated to a particular activity. Hence, SAR can be used to assess the affects of changes in structure on an activity.

As used herein, "functional activity" refer to activities of a polypeptide (e.g. target protein) or portion thereof associated with a full-length (complete) protein. Functional activities include, but are not limited to, biological activity, catalytic or enzymatic activity, antigenicity (ability to bind to or compete with a polypeptide for binding to an anti-polypeptide antibody), immunogenicity, ability to form multimers, the ability to specifically bind to a receptor or ligand for the polypeptide and signaling and downstream effector functions. For purposes herein, modulation (i.e. activation or inhibition) of a functional activity of a polypeptide by an antibody or portion thereof in the libraries herein means that a functional activity of the polypeptide is changed or altered in the presence of the antibody compared to the absence of the antibody or portion thereof.

As used herein, "modulate" or "modulation" and other various grammatical forms thereof with reference to the effect of an antibody or portion thereof on the functional activity of a target protein refers to increased activity such as induction or potentiation of activity, as well as inhibition of one or more activities of the target protein. Hence, modulation can include an increase in the activity (i.e., up-regulation or agonist activity) a decrease in activity (i.e., down-regulation or inhibition) or any other alteration in an activity (such as a change in periodicity, frequency, duration, kinetics or other parameter). Modulation can be context dependent and typically modulation is compared to a designated state, for example, the wildtype protein, the protein in a constitutive state, or the protein as expressed in a designated cell type or condition. The functional activity of a target protein by an antibody or portion thereof can be modulated by 10%, 20%, 30%, 40%, 50%, 60%, 70%, 80%, 90% or more compared to the activity of the target protein in the abasence of the antibody or portion thereof.

As used herein, "agonist" refers to an antibody or portion thereof that modulates signal transduction or other functional activity of a receptor by potentiating, inducing or otherwise enhancing the signal transduction activity or other functional activity of a receptor. Agonists can modulate signal transduction or other functional activity when used alone or can alter signal transduction or other functional activity in the presence of the natural ligand of the receptor or other receptor stimulator to enhance signaling by the receptor compared to the ligand alone.

As used herein, "antagonist" refers to an antibody or portion thereof that modulates signal transduction or other functional activity of a receptor by blocking or decreasing the signal transduction activity or other functional activity of a receptor As used herein, a label is a detectable marker that can be attached or linked directly or indirectly to a molecule or associated therewith. The detection method can be any method known in the art.

As used herein, binding activity refer to characteristics of a molecule, e.g. a polypeptide, relating to whether or not, and how, it binds one or more binding partners. Binding activities include ability to bind the binding partner(s), the affinity with which it binds to the binding partner (e.g. high affinity), the avidity with which it binds to the binding partner, the strength of the bond with the binding partner and specificity for binding with the binding partner.

As used herein, "affinity" or "binding affinity" refers to the strength with which an antibody molecule or portion thereof binds to an epitope on a target protein or antigen. Affinity is often measured by equilibrium association constant ($K_A$) or equilibrium dissociation constant ($K_D$). Low-affinity antibody-antigen interaction is weak, and the molecules tend to dissociate rapidly, while high affinity antibody-antigen binding is strong and the molecules remain bound for a longer amount of time. A high antibody affinity means that the antibody specifically binds to a target protein with an equilibrium association constant ($K_A$) of greater than or equal to about $10^6 M^{-1}$, greater than or equal to about $10^7 M^{-1}$, greater than or equal to about $10^8 M^{-1}$, or greater than or equal to about $10^9 M^{-1}$, $10^{10} M^{-1}$, $10^{11} M^{-1}$ or $10^{12} M^{-1}$. Antibodies also can be characterized by an equilibrium dissociation constant ($K_D$), for example, $10^{-4} M$, $10^{-8} M$, $10^{-8} M$, $10^{-7} M$, $10^{-8} M$, $10^{-10} M$, $10^{-11} M$ or $10^{-12} M$ or lower. Generally, antibodies having a nanomolar or sub-nanomolar dissociaton constant are deemed to be high affinity antibodies. Such affinities can be readily determined using conventional techniques, such as by equilibrium dialysis; by using the BIAcore 2000 instrument, using general procedures outlined by the manufacturer; by radioimmunoassay using radiolabeled target antigen; or by another method known to the skilled artisan. The affinity data can be analyzed, for example, by the method of Scatchard et al., *Ann N.Y. Acad. Sci.*, 51:660 (1949).

As used herein, "epitope" refers to the localized region on the surface of an antigen or protein that is recognized by an antibody. Peptide epitopes include those that are continuous epitopes or discontinuous epitopes. An epitope is generally determined by the three dimensional structure of a protein as opposed to the linear amino acid sequence.

As used herein, "epitope mapping" is the process of identification of the molecular determinants for antibody-antigen recognition.

As used herein, Basic Local Alignment Search Tool (BLAST) is a search algorithm developed by Altschul et al. (1990) to separately search protein or DNA databases, for example, based on sequence identity. For example, blastn is a program that compares a nucleotide query sequence against a nucleotide sequence database (e.g. GenBank). BlastP is a program that compares an amino acid query sequence against a protein sequence database.

As used herein, a BLAST bit score is a value calculated from the number of gaps and substitutions associated with each aligned sequence. The higher the score, the more significant the alignment.

As used herein, a human protein is one encoded by a nucleic acid molecule, such as DNA, present in the genome of a human, including all allelic variants and conservative variations thereof. A variant or modification of a protein is a human protein if the modification is based on the wildtype or prominent sequence of a human protein.

As used herein, "naturally occurring amino acids" refer to the 20 L-amino acids that occur in polypeptides. The residues are those 20 a-amino acids found in nature which are incorporated into protein by the specific recognition of the charged tRNA molecule with its cognate mRNA codon in humans.

As used herein, non-naturally occurring amino acids refer to amino acids that are not genetically encoded. For example, a non-natural amino acid is an organic compound that has a structure similar to a natural amino acid but has been modified structurally to mimic the structure and reactivity of a natural amino acid. Non-naturally occurring amino acids thus include, for example, amino acids or analogs of amino acids other than the 20 naturally-occurring amino acids and include, but are not limited to, the D-isostereomers of amino acids. Exemplary non-natural amino acids are known to those of skill in the art.

As used herein, nucleic acids include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is from 2 to 40 amino acids in length. As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH$_2$ refers to the free amino group present at the amino terminus of a polypeptide. COOH refers to the free carboxy group present at the carboxyl terminus of a polypeptide. In keeping with standard polypeptide nomenclature described in *J. Biol. Chem.*, 243: 3557-3559 (1968), and adopted 37 C.F.R. '§§1.821-1.822, abbreviations for amino acids residues are shown in Table 1:

TABLE 1

Table of Correspondence

SYMBOL

| 1-Letter | 3-Letter | AMINO ACID |
|---|---|---|
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as NH$_2$ or to a carboxyl-terminal group such as COOH. The abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726). Each naturally occurring L-amino acid is identified by the standard three letter code (or single letter code) or the standard three letter code (or single letter code) with the prefix "L-"; the prefix "D-" indicates that the stereoisomeric form of the amino acid is D.

As used herein, an isokinetic mixture is one in which the molar ratios of amino acids has been adjusted based on their reported reaction rates (see, e.g., Ostresh et al., (1994) *Biopolymers* 34:1681).

As used herein, modification is in reference to modification of a sequence of amino acids of a polypeptide or a sequence of nucleotides in a nucleic acid molecule and includes deletions, insertions, and replacements of amino acids and nucleotides, respectively. Methods of modifying a polypeptide are routine to those of skill in the art, such as by using recombinant DNA methodologies.

As used herein, suitable conservative substitutions of amino acids are known to those of skill in this art and can be made generally without altering the biological activity of the resulting molecule. Those of skill in this art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. co., p. 224). Such substitutions can be made in accordance with those set forth in TABLE 2 as follows:

TABLE 2

| Original residue | Exemplary conservative substitution |
|---|---|
| Ala (A) | Gly; Ser |
| Arg (R) | Lys |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with known conservative substitutions.

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term "nucleic acid" refers to single-stranded and/or double-stranded polynucleotides such as deoxyribonucleic acid (DNA), and ribonucleic acid (RNA) as well as analogs or derivatives of either RNA or DNA. Also included in the term "nucleic acid" are analogs of nucleic acids such as peptide nucleic acid (PNA), phosphorothioate DNA, and other such analogs and derivatives or combinations thereof. Nucleic acid can refer to polynucleotides such as deoxyribonucleic acid (DNA) and ribonucleic acid (RNA). The term also includes, as equivalents, derivatives, variants and analogs of either RNA or DNA made from nucleotide analogs, single (sense or antisense) and double-stranded polynucleotides. Deoxyribonucleotides include deoxyadenosine, deoxycytidine, deoxyguanosine and deoxythymidine. For RNA, the uracil base is uridine.

As used herein, "nucleic acid molecule encoding" refers to a nucleic acid molecule which directs the expression of a specific protein or peptide. The nucleic acid sequences include both the DNA strand sequence that is transcribed into RNA and the RNA sequence that is translated into protein or peptide. The nucleic acid molecule includes both the full length nucleic acid sequences as well as non-full length sequences derived from the full length mature polypeptide, such as for example a full length polypeptide lacking a precursor sequence. For purposes herein, a nucleic acid sequence also includes the degenerate codons of the native sequence or sequences which can be introduced to provide codon preference in a specific host.

As used herein, the term "polynucleotide" refers to an oligomer or polymer containing at least two linked nucleotides or nucleotide derivatives, including a deoxyribonucleic acid (DNA), a ribonucleic acid (RNA), and a DNA or RNA derivative containing, for example, a nucleotide analog or a "backbone" bond other than a phosphodiester bond, for example, a phosphotriester bond, a phosphoramidate bond, a phophorothioate bond, a thioester bond, or a peptide bond (peptide nucleic acid). The term "oligonucleotide" also is used herein essentially synonymously with "polynucleotide," although those in the art recognize that oligonucleotides, for example, PCR primers, generally are less than about fifty to one hundred nucleotides in length.

Polynucleotides can include nucleotide analogs, including, for example, mass modified nucleotides, which allow for mass differentiation of polynucleotides; nucleotides containing a detectable label such as a fluorescent, radioactive, luminescent or chemiluminescent label, which allow for detection of a polynucleotide; or nucleotides containing a reactive group such as biotin or a thiol group, which facilitates immobilization of a polynucleotide to a solid support. A polynucleotide also can contain one or more backbone bonds that are selectively cleavable, for example, chemically, enzymatically or photolytically. For example, a polynucleotide can include one or more deoxyribonucleotides, followed by one or more ribonucleotides, which can be followed by one or more deoxyribonucleotides, such a sequence being cleavable at the ribonucleotide sequence by base hydrolysis. A polynucleotide also can contain one or more bonds that are relatively resistant to cleavage, for example, a chimeric oligonucleotide primer, which can include nucleotides linked by peptide nucleic acid bonds and at least one nucleotide at the 3' end, which is linked by a phosphodiester bond or other suitable bond, and is capable of being extended by a polymerase. Peptide nucleic acid sequences can be prepared using well-known methods (see, for example, Weiler et al. Nucleic acids Res. 25: 2792-2799 (1997)).

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

"Identity" per se has an art-recognized meaning and can be calculated using published techniques. (See, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and Sequence Analysis Primer, Gribskov, M. and Devereux, J., eds., M Stockton Press, New York, 1991). While there exists a number of methods to measure identity between two polynucleotide or polypeptides, the term "identity" is well known to skilled artisans (Carillo, H. & Lipton, D., *SIAM J Applied Math* 48:1073 (1988)).

As used herein, homologous (with respect to nucleic acid and/or amino acid sequences) means about greater than or equal to 25% sequence homology, typically greater than or equal to 25%, 40%, 50%, 60%, 70%, 80%, 85%, 90% or 95% sequence homology; the precise percentage can be specified if necessary. For purposes herein the terms "homology" and "identity" are often used interchangeably, unless otherwise indicated.

In general, for determination of the percentage homology or identity, sequences are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al. (1988) *SIAM J Applied Math* 48:1073). By sequence homology, the number of conserved amino acids is determined by standard alignment algorithms programs, and can be used with default gap penalties established by each supplier. Substantially homologous nucleic acid molecules hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al. (1988) *Proc. Natl. Acad. Sci. USA* 85:2444 (other programs include the GCG program package (Devereux, J., et al., *Nucleic Acids Research* 12(I): 387 (1984)), BLASTP, BLASTN, FASTA (Atschul, S. F., et al., *J Molec Biol* 215:403 (1990)); Guide to Huge Computers, Martin J. Bishop, ed., Academic Press, San Diego, 1994, and Carillo et al. (1988) *SIAM J Applied Math* 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.). Percent homology or identity of proteins and/or nucleic acid molecules can be determined, for example, by comparing sequence information using a GAP computer program (e.g., Needleman et al. (1970) *J. Mol. Biol.* 48:443, as revised by Smith and Waterman ((1981) *Adv. Appl. Math.* 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) *Nucl. Acids Res.* 14:6745, as described by Schwartz and Dayhoff, eds., *ATLAS OF PROTEIN SEQUENCE AND STRUCTURE*, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term at least "90% identical to" refers to percent identities from 90 to 99.99 relative to the reference nucleic acid or amino acid sequence of the polypeptide. Identity at a level of 90% or more is indicative of the fact that, assuming for exemplification purposes a test and reference polypeptide length of 100 amino acids are compared. No more than 10% (i.e., 10 out of 100) of the amino acids in the test polypeptide differs from that of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g. 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often by manual alignment without relying on software.

As used herein, a polypeptide containing a specified percentage of amino acids set forth in a reference polypeptide refers to the proportion of contiguous identical amino acids shared between a polypeptide and a reference polypeptide. For example, an isoform that contains 70% of the amino acids set forth in a reference polypeptide having a sequence of amino acids set forth in SEQ ID NO:XX, which recites 147 amino acids, means that the reference polypeptide contains at least 103 contiguous amino acids set forth in the amino acid sequence of SEQ ID NO:XX.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that a certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer" pair refers to a set of primers that includes a 5' (upstream) primer that hybridizes with the 5' end of a sequence to be amplified (e.g. by PCR) and a 3' (downstream) primer that hybridizes with the complement of the 3' end of the sequence to be amplified.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90% or 95% identity or greater with a wildtype and/or predominant form, including 96%, 97%, 98%, 99% or greater identity with a wildtype and/or predominant form of a polypeptide. Reference to an allelic variant herein generally refers to variations n proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include substitutions, deletions and insertions of nucleotides. An allele of a gene also can be a form of a gene containing a mutation.

As used herein, species variants refer to variants in polypeptides among different species, including different mammalian species, such as mouse and human.

As used herein, a splice variant refers to a variant produced by differential processing of a primary transcript of genomic DNA that results in more than one type of mRNA.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification does not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

The term substantially free of cellular material includes preparations of proteins in which the protein is separated from cellular components of the cells from which it is isolated or recombinantly-produced. In one embodiment, the term substantially free of cellular material includes preparations of protease proteins having less that about 30% (by dry weight) of non-protease proteins (also referred to herein as a contaminating protein), generally less than about 20% of non-protease proteins or 10% of non-protease proteins or less that about 5% of non-protease proteins. When the protease protein or active portion thereof is recombinantly produced, it also is substantially free of culture medium, i.e., culture medium represents less than about or at 20%, 10% or 5% of the volume of the protease protein preparation.

As used herein, the term substantially free of chemical precursors or other chemicals includes preparations of protease proteins in which the protein is separated from chemical precursors or other chemicals that are involved in the synthesis of the protein. The term includes preparations of protease proteins having less than about 30% (by dry weight) 20%, 10%, 5% or less of chemical precursors or non-protease chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means by using recombinant DNA methods means the use of the well known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, operably or operatively linked when referring to DNA segments means that the segments are arranged so that they function in concert for their intended purposes, e.g., transcription initiates in the promoter and proceeds through the coding segment to the terminator.

As used herein, biological sample refers to any sample obtained from a living or viral source and includes any cell type or tissue of a subject from which nucleic acid or protein or other macromolecule can be obtained. Biological samples include, but are not limited to, body fluids, such as blood, plasma, serum, cerebrospinal fluid, synovial fluid, urine and sweat, tissue and organ samples from animals and plants. Also included are soil and water samples and other environmental samples, viruses, bacteria, fungi, algae, protozoa and components thereof. Hence bacterial and viral and other contamination of food products and environments can be assessed. The methods herein are practiced using biological samples and in some embodiments, such as for profiling, also can be used for testing any sample.

As used herein, macromolecule refers to any molecule having a molecular weight from the hundreds up to the millions. Macromolecules include peptides, proteins, nucleotides, nucleic acids, and other such molecules that are generally synthesized by biological organisms, but can be prepared synthetically or using recombinant molecular biology methods.

As used herein, the term "biopolymer" is a biological molecule, including macromolecules, composed of two or more monomeric subunits, or derivatives thereof, which are linked by a bond or a macromolecule. A biopolymer can be, for example, a polynucleotide, a polypeptide, a carbohydrate, or a lipid, or derivatives or combinations thereof, for example, a nucleic acid molecule containing a peptide nucleic acid portion or a glycoprotein, respectively. Biopolymers include, but are not limited to, nucleic acids, proteins, polysaccharides, lipids and other macromolecules. Nucleic acids include DNA, RNA, and fragments thereof. Nucleic acids can be derived from genomic DNA, RNA, mitochondrial nucleic acid, chloroplast nucleic acid and other organelles with separate genetic material.

As used herein, a biomolecule is any compound found in nature, or derivatives thereof. Biomolecules include, but are not limited to: oligonucleotides, oligonucleosides, proteins, peptides, amino acids, peptide nucleic acids (PNAs), oligosaccharides and monosaccharides.

As used herein, a biological particle refers to a virus, such as a viral vector or viral capsid with or without packaged nucleic acid, phage, including a phage vector or phage capsid, with or without encapsulated nucleic acid, a single cell, including eukaryotic and prokaryotic cells or fragments thereof, a liposome or micellar agent or other packaging particle, and other such biological materials.

As used herein, a composition refers to any mixture. It can be a solution, a suspension, liquid, powder, a paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof.

As used herein, kit refers to a packaged combination, optionally including instructions and/or reagents for their use.

As used herein, fluid refers to any composition that can flow. Fluids thus encompass compositions that are in the form of semi-solids, pastes, solutions, aqueous mixtures, gels, lotions, creams and other such compositions.

As used herein, antigenic means that a polypeptide induce an immune response. Highly antigenic polypeptides are those that reproducibly and predictably induce an immune response.

As used herein, a pharmaceutical effect or therapeutic effect refers to an effect observed upon administration of an agent intended for treatment of a disease or disorder or for amelioration of the symptoms thereof.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are those involving a specific target protein including those mediated by a target protein and those in which a target protein plays a role in the etiology or pathology. Exemplary target proteins and associated diseases and disorders are described elsewhere herein.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease. Treatment also encompasses any pharmaceutical use of a modified interferon and compositions provided herein.

As used herein, a therapeutic agent, therapeutic regimen, radioprotectant, or chemotherapeutic mean conventional drugs and drug therapies, including vaccines, which are known to those skilled in the art. Radiotherapeutic agents are well known in the art.

As used herein, treatment means any manner in which the symptoms of a condition, disorder or disease or other indication, are ameliorated or otherwise beneficially altered.

As used herein therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, the term "subject" refers to an animal, including a mammal, such as a human being.

As used herein, a patient refers to a human subject.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, prevention or prophylaxis refers to methods in which the risk of developing disease or condition is reduced.

As used herein, an effective amount is the quantity of a therapeutic agent necessary for preventing, curing, ameliorating, arresting or partially arresting a symptom of a disease or disorder.

As used herein, administration refers to any method in which an antibody or protion thereof is contacted with its target protein. Administration can be effected in vivo or ex vivo or in vitro. For example, for ex vivo administration a body fluid, such as blood, is removed from a subject and contacted outside the body with the antibody or portion thereof. For in vivo administration, the antibody or portion thereof can be introduced into the body, such as by local, topical, systemic and/or other route of introduction. In vitro administration encompasses methods, such as cell culture methods.

As used herein, unit dose form refers to physically discrete units suitable for human and animal subjects and packaged individually as is known in the art.

As used herein, a single dosage formulation refers to a formulation for direct administration.

As used herein, an "article of manufacture" is a product that is made and sold. As used throughout this application, the term is intended to encompass compiled germline antibodies or antibodies obtained therefrom contained in articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, animal includes any animal, such as, but are not limited to primates including humans, gorillas and monkeys; rodents, such as mice and rats; fowl, such as chickens; ruminants, such as goats, cows, deer, sheep; ovine, such as pigs and other animals. Non-human animals exclude humans as the contemplated animal. The germline segments, and resulting antibodies, provided herein are from any source, animal, plant, prokaryotic and fungal. Most germline segments, and resulting antibodies, are of animal origin, including mammalian origin.

As used herein, a control refers to a sample that is substantially identical to the test sample, except that it is not treated with a test parameter, or, if it is a sample plasma sample, it can be from a normal volunteer not affected with the condition of interest. A control also can be an internal control.

As used herein, the singular forms "a," "an" and "the" include plural referents unless the context clearly dictates otherwise. Thus, for example, reference to a compound, comprising "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. Overview

Provided are methods for generating combinatorial libraries (i.e. collections) of functional antibodies, and the resulting libraries. The collections or libraries provided are addressable, where antibodies within each address have the same sequence, are known a priori, and are different from the antibodies at each other address in the collection. The collections can be provided as physical arrays or the members can be otherwise identified so that they can be sorted. The arrayed collections of antibodies can represent the complete repertoire of combined germline portions, a selected portion thereof, or collections of modified forms thereof. The members of the libraries are individually designed and addressed. Because of this, the libraries are highly diverse, permitting creation of libraries with far fewer members than other libraries, but having higher diversity. The libraries provided herein contain as few as $10^2$ members and typically contain about or $10^8$, $10^4$, $2\times10^4$, $3\times10^4$, $4\times10^4$, $5\times10^4$, $6\times10^4$, $7\times10^4$, $8\times10^4$, $9\times10^4$, $10^8$ and more unique members, including about or $10^6$, $10^7$, $10^8$, $10^8$ and more unique members.

The collections of antibodies are addressable, such as in arrays or other addressable format, such that each member is identifiable and each locus has antibodies that are the same or that have the same binding specificity at each locus. The locus can be a physical locus or can be otherwise identifiable and sortable, such as an RF tag, attachment to label with a bar code, attachment to a chemical tag, in manners described for chemical libraries.

In contrast, other antibody libraries are produced such that they contain mixtures of antibodies at a locus, or contain unidentified members of libraries. Exemplary of such libraries are those described in any of the following: European Patent Application Nos. EP0368684 and EP89311731; International Published Patent Application Nos. WO92/001047, WO 02/38756, WO 97/08320, WO 2005/023993, WO 07/137616 and WO 2007/054816; U.S. Pat. Nos. 6,593,081 and 6,989,250; United States Published Patent Application No. US 2002/0102613, US 2003/153038, US 2003/0022240, US 2005/0119455, US 2005/0079574 and US 2006/0234302; and Orlandi et al. (1989) *Proc Natl. Acad. Sci. U.S.A.*, 86:3833-3837; Ward et al. (1989) *Nature,* 341:544-546; Huse et al. (1989) *Science,* 246:1275-1281; Burton et al. (1991) *Proc. Natl. Acad. Sci., U.S.A.*, 88:10134-10137; Marks et al. (1991) *J Mol Biol,* 222:581-591; Hoogenboom et al. (1991) *J Mol Biol,* 227:381-388; Nissim et al. (1994) *EMBO J,* 13:692-698; Barbas et al. (1992) *Proc. Natl. Acad. Sci., U.S.A.*, 89:4457-4461; Akamatsu et al. (1993) *J. Immunol.,* 151:4651-1659; Griffiths et al. (1994) *EMBO J,* 13:3245-3260; Fellouse (2004) PNAS, 101:12467-12472; Persson et al. (2006) J. Mol. Biol. 357:607-620; Knappik et al. (2000) J. Mol. Biol. 296:57-86; Rothe et al. (2008) J. Mol. Biol. 376:1182-1200; Mondon et al. (2008) *Frontiers in Bioscience,* 13:1117-1129; and Behar, I (2007) *Expert Opin. Biol. Ther.,* 7:763-779.

Although many of these libraries contain large numbers of members (e.g. $10^8$-$10^{10}$ members), there is no mechanism to ensure that all members are functional, nor to maximize diversity nor to represent the complete repertoire of germline sequences or a selected portion thereof. Thus, the composition and diversity of the library is not optimal. For example, many existing libraries are developed by PCR amplification of germline sequences. PCR amplification introduces errors into the resulting amplified products. In addition, in some methods hybrid primers are used to facilitate recombination of individual V(D)J segments. This can result in recombination events that are "out-of-frame" resulting in non-functional members. Also, in practicing such methods, members either are pooled (such as in a tube or via phage display) and screened together for binding to a target substrate or are introduced into host cells as mixtures and then colonies are individually picked and grown. Upon identification of a positive interaction or other selected events, any "Hits" must be further characterized in order to be identified.

The combinatorial addressable libraries of antibodies provided herein do not share these problems. Each member of the collection is addressed, such that each member occupies a unique locus, for example, a spatial array or other array or other identifiable address (e.g., presentation in well-plates; being bound to a support or chip, bar-coded, color-coded, RF-tag labeled support or other such addressable format). Displaying members on an address is facilitated because each member is individually generated, and thus the sequence of each member is known. Display of the members can be achieved on any desired format, which permits screening the members not only for binding but also for function. The "Hits" can be quickly identified coincident with the screening results. Hence, structure/activity relationships (SAR) between members of the collections can be performed to identify similarities in characteristics or sequences between and among identified "Hits". Pharmacokinetics and dose-responses also are available on screening or immediately following "Hit" identification. Further optimization of "Hits" can be performed such as by mutagenesis and iterative screening. Accordingly, the methods provided herein for generating addressable combinatorial antibody collections and the resulting collections offer a robust alternative to identification of antibodies with desired specificities and/or activities, for example, for use as therapeutic antibodies.

1. Methods of Generating Addressable Combinatorial Antibody Collections

In one example of the methods provided herein, variable heavy (VH) and variable light (VL) chain members of the libraries are generated, recombinantly or synthetically by DNA synthesis, from known germline antibody sequences or modified sequences thereof. Thus, the members can represent the entire repertoire of the naïve germline, and are not restricted based on selection against "self" proteins. Combinatorial diversity in the collection exists from recombination (e.g. such as performed in silico by computer software as described herein) of individual V, D and J segments that make up the variable heavy chain and of individual V ($V_\kappa$, or $V_\lambda$) and J ($J_\kappa$, or $J_\lambda$) segments that make up the variable light chains (see FIG. 1). The sequences can be joined together by random recombination of all combinations of V(D)J segments generating maximal combinatorial diversity. Alternatively, the V(D)J segments can be recombined using rational or semi-rational approaches such that a specific sequence or subset of sequences are used in generating the members of the library. For example, germline segments can be selected based on sequence similarities or differences or based on shared characteristics (e.g., a V region family, CDR3 length or composition or other biochemical attribute).

In the methods herein, the combinatorial diversity of the resulting members is optimized for functioning sequences that encode a full length polypeptide. Although all combinations of V(D)J segments can be recombined, the joints in the compiled sequences between the different V(D)J sequences are selected so that the resulting sequences are in-frame. Each functioning member occupies an address (e.g. a position in a well or chip) of a collection. In vivo, however, junctional diversity exists upon V(D)J recombination such that nucleotides are often inserted at junction regions, which can result in new amino acids at the junctions. Hence, in some example of the methods herein, the resulting in-frame members can be subjected to mutagenesis, for example, to introduce diversity at the junction regions (e.g., junctional diversity). In such examples, each locus can contain a pool of antibodies with the same V(D)J segments, but differing from each other by one or more mutations (e.g. insertions, deletions or replacements of amino acids).

In addition to generating naïve antibody libraries, the methods provided herein can be used to generate directed antibody libraries, whereby the resulting members are optimized against known targets. For example, the starting sequences of individual V(D)J segments of heavy and light chains can be generated to contain a known binding peptide against a target. The goal of such a library format is to generate a platform that allows the discovery of agonist or antagonist antibodies that mimic therapeutic targets, for example, growth factors, cytokines, hormones or other cellular activators.

Generally, the members of the collections provided herein contain all or a portion of a variable light (VL) and variable heavy (VH) chain, so long as the resulting antibody is sufficient to form an antigen binding site. Hence, in addition to combinatorial diversity, diversity in the collections provided herein is achieved by pairing diversity by combining heavy and light chains (FIG. 1). Thus, the individually recombined VL and VH chains as discussed above can themselves be paired in varying combinations to generate a scalable collection of all possible combinations of VL and VH chains, or a subset thereof. For example, a library can be generated where all members have the same VH chains, but are paired with all or a subset of the individually recombined VL members. The heavy and light chain members can be paired by direct or indirect linkage. The resulting pairs of heavy and light chains can be presented in any desired library format, such as a complete antibody, Fab forms, single chain (sc) Fv forms, or any multimeric form thereof.

2. The Resulting Libraries

Provided herein are libraries of nucleic acid molecules encoding VL chains and libraries of nucleic acid molecules encoding VH chains. Also provided herein are combinatorial antibody libraries that are paired antibody libraries containing at a minimum all or a portion of a VL and VH chains, such that each resulting member in the library is sufficient to form an antigen binding site. The libraries can be naïve libraries representing all or a portion of all possible germline antibodies, or can be modified forms thereof. The resulting members of the paired antibody collections include, but are not limited to, Fab, single chain (sc) Fv, disulfide-stabilized Fv and multimeric formats such as minibodies, bis-scFv, diabodies, triabodies and tetrabodies. The libraries provided herein differ from existing antibody collections because each individual member of the collection is known and, in the case of the antibody libraries, each member is "productive" or "functional" because the encoding nucleic acid molecules lack stop codons that can otherwise truncate the resulting protein before a full length polypeptide can be produced. Typically, all libraries provided herein are in an addressable format, such that the identity of each member of the library is known based on its locus or "address". Exemplary of antibody collections provided herein are combinatorial Fab libraries, such as addressable combinatorial Fab libraries. Any of the above libraries can include $10^2$, $10^3$, $10^4$ or $10^5$, or more different members.

3. Applications of the Libraries

The resulting libraries can be used for any application or purpose as desired. Because of their diversity, specificity and effector functions, antibodies are attractive candidates for protein-based therapeutics. Thus, the libraries can be used in methods of screening for various activities to identify antibodies with unique functions, such as for use as therapeutic antibodies. For example, the antibody libraries provided herein can be used in screening assays based on function or binding against unknown or known targets. In particular, it is contemplated herein that the resulting libraries can be used in functional assays, such as cell based assays, to discover new MAbs (e.g., Fabs) against selected targets. Hence, the libraries provided herein offer advantages over existing libraries because they permit identification of antibodies that perhaps are low affinity binders, but functionally are ideal therapeutic antibody candidates. Accordingly, both agonist and antagonist antibodies can be easily discovered.

Figure 2A:
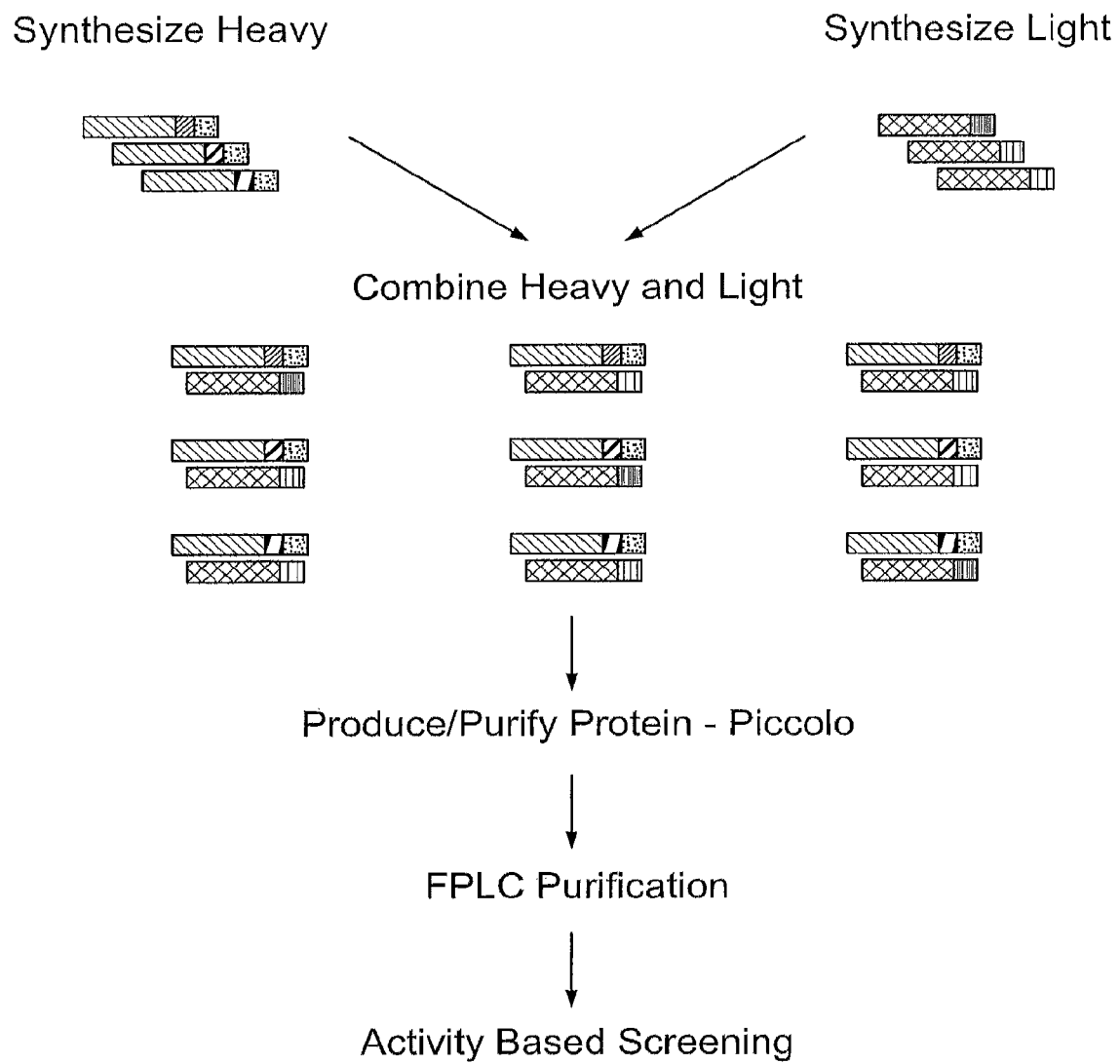
FIG. 2a is a depiction of the methods of 1) combining heavy and light germ line segments to generate nucleic acid sequences encoding a variable heavy and light chain; 2) synthesizing the nucleic acid molecules; 3) generating a plurality of antibodies by expression and association of the heavy and light chains; purifying the antibodies (e.g. using Piccolo and FLPC purification) and screening the antibodies for an activity (e.g. binding or a functional activity).
Figure 2B:
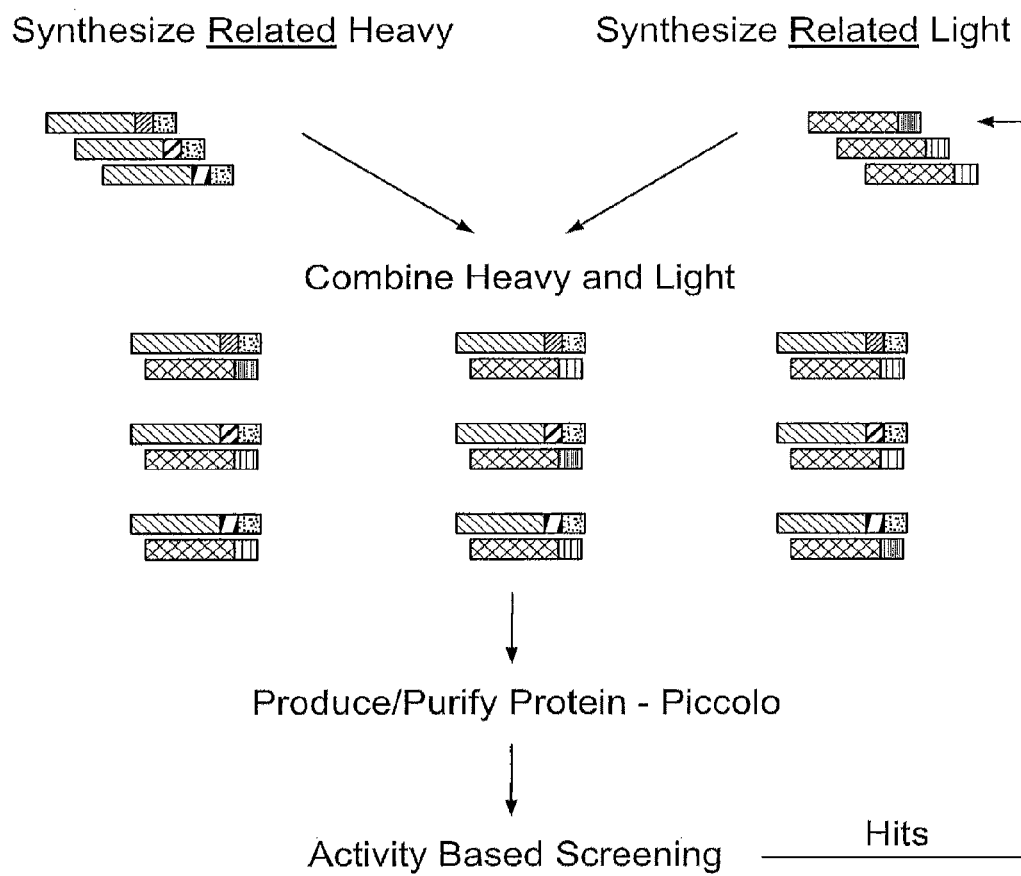
FIG. 2b is a depiction of iterative methods to identify additional related antibodies involving repeating the method based on identified "HITS" to identify HITs that are optimized or improved for the activity.

The resulting identified "Hits" can be further optimized against a desired target by iterative screening methods of antibody discovery (FIG. 2). For example, antibody "Hits" identified from binding or activity-based screening assays, can be used to generate further libraries containing V(D)J germline segments related (e.g., by sequence identity or similarity) to the V(D)J germline segments in the identified Hit(s). By virtue of the fact that the collections are arrayed, such that the identity of each individual member in the collection is known, iterative approaches can be used for the rapid expansion of "Hits" to identify antibody "Hits" with improved therapeutic applications. In addition, antibody "Hits" can be used as a scaffold for mutagenesis to generate modified heavy and light chains, and for successive generations of libraries of nucleic acid molecules encoding modified VL chains, libraries of nucleic acid molecules encoding modified VH chains and antibody libraries minimally containing modified VL and VH chains.

Finally, antibody "Hits" identified from the libraries herein and/or further optimized by iterative screening and/or other mutagenesis methods, can be used in a variety of in vitro and in vivo applications by virtue of the specificity for one or more target proteins. For example, the antibodies can be used in diagnostic methods. In another example, the antibodies can be used in methods of treatment and other uses for treating a disease or disorder which is associated with expression or activation of a particular target protein, and for which the antibody can modulate.

The following sections describe exemplary components of the methods and libraries, the methods of generating combinatorial antibody libraries, including arrayed libraries, the resulting libraries and applications of the libraries.

C. Antibodies

Provided herein are methods of generating libraries of addressable combinatorial antibodies, and the resulting libraries and antibodies. The antibodies in the libraries minimally include all or a portion of a variable heavy chain (VH) and/or a variable light (VL) chain so long as the antibody contains a sufficient antibody binding site. For example, the VH and VL chains of the antibodies provided herein typically include one or more, generally two or more, and up to all of the three CDRs making up the antigen binding site. In some examples, the antibodies can be generated to contain a synthetic CDR, whereby a peptide against a known target is grafted into the CDR regions of the variable region to effect directed binding and activation of the target (see e.g., Frederickson et al. (2006) *PNAS* 103: 14307-14312).

Optionally, the antibodies can include all or a portion of the constant heavy chain (e.g. one or more CH domains such as CH1, CH2, CH3 and CH4 and/or a constant heavy chain (CL)). Hence, the antibodies included in the libraries herein include those that are full-length antibodies, and also include fragments or portions thereof including, for example, Fab, Fab', F(ab')$_2$, single-chain Fvs (scFv), Fv, dsFv, diabody, Fd and Fd' fragments Fab fragments, Fd fragments, scFv fragments, and scFab fragments. For example, antibodies in the libraries provided herein include Fabs.

A description of the structure, sequence and function of antibodies are known to one of skill in the art and one of skill in the art is familiar with the mechanisms that give rise to diversity in the germline. It is contemplated herein that libraries of combinatorial antibodies can be made by recombination of germline DNA sequences that mimic the process of germline recombination during B cell differentiation. Such recombination can be performed in silico (e.g., by a computer) as described herein or can be performed manually using molecular biology techniques. Recombined sequences can be individually generated, such as by DNA synthesis or by recombinant DNA techniques, to generate all permutations of variable heavy and light chain sequences. The antibodies can be expressed in any desired form, and in some instances, pairing of variable and constant regions can be achieved. The result is that the libraries of combinatorial antibodies provided herein can represent the entire naïve antibody repertoire or a subset thereof.

1. Antibody Polypeptides

Antibodies are produced naturally by B cells in membrane-bound and secreted forms. Antibodies specifically recognize and bind antigen epitopes through cognate interactions. Antibody binding to cognate antigens can initiate multiple effector functions, which cause neutralization and clearance of toxins, pathogens and other infectious agents. Diversity in antibody specificity arises naturally due to recombination events during B cell development. Through these events, various combinations of multiple antibody V, D and J gene segments, which encode variable regions of antibody molecules, are joined with constant region genes to generate a natural antibody repertoire with large numbers of diverse antibodies. A human antibody repertoire contains more than $10^{10}$ different antigen specificities and thus theoretically can specifically recognize any foreign antigen. Antibodies include such naturally produced antibodies, as well as synthetically, i.e. recombinantly, produced antibodies, such as antibody fragments.

In folded antibody polypeptides, binding specificity is conferred by antigen binding site domains, which contain portions of heavy and/or light chain variable region domains. Other domains on the antibody molecule serve effector functions by participating in events such as signal transduction and interaction with other cells, polypeptides and biomolecules. These effector functions cause neutralization and/or clearance of the infecting agent recognized by the antibody.

2. Antibody Structural and Functional Domains

A full-length antibody contains four polypeptide chains, two identical heavy (H) chains (each usually containing about 440 amino acids) and two identical light (L) chains (each containing about 220 amino acids). The light chains exist in two distinct forms called kappa (κ) and lambda (λ). Each chain is organized into a series of domains organized as immunoglobulin (Ig) domains, including variable (V) and constant (C) region domains. Light chains have two domains, corresponding to the C region (CL) and the V region (VL). Heavy chains have four domains, the V region (VH) and three or four domains in the C region (CH1, CH2, CH3 and CH4), and, in some cases, hinge region. The four chains (two heavy and two light) are held together by a combination of covalent and non-covalent (disulfide) bonds.

Antibodies include those that are full-lengths and those that are fragments thereof, namely Fab, Fab', F(ab')$_2$, single-chain Fvs (scFv), Fv, dsFv, diabody, Fd and Fd' fragments. The fragments include those that are in single-chain or dimeric form. The Fv fragment, which contains only the VH and VL domain, is the smallest immunoglobulin fragment that retains the whole antigen-binding site (see, for example, *Methods in Molecular Biology*, Vol 207: *Recombinant Antibodies for Cancer Therapy Methods and Protocols* (2003); Chapter 1; p 3-25, Kipriyanov). Stabilization of Fv are achieved by direct linkage of the VH and VL chains, such as for example, by linkage with peptides (to generate single-chain Fvs (scFv)), disulfide bridges or knob-into-hole mutations. Fab fragments, in contrast, are stable because of the presence of the CH1 and CL domains that hold together the variable chains. Fd antibodies, which contain only the VH domain, lack a complete antigen-binding site and can be insoluble.

3. Antibody Sequence and Specificity

The variable region of the heavy and light chains are encoded by multiple germline gene segments separated by non-coding regions, or introns, and often are present on different chromosomes. For example, the genes for the immunoglobulin heavy chain region contains approximately 65 variable ($V_H$) genes, 27 Diversity ($D_H$) genes, and 6 Joining ($J_H$) genes. The kappa (κ) and lambda (λ) light chains are also each encoded by a similar number of $V_L$ and $J_L$ gene segments, but do not include any D gene segments. Exemplary $V_H$, $D_H$, $J_H$ and $V_L$ ($V_κ$ or $V_λ$) and $J_L$ ($J_κ$ or $J_λ$) germline gene segments are set forth in Tables 3-5.

During B cell differentiation germline DNA is rearranged whereby one $D_H$ and one $J_H$ gene segment of the heavy chain locus are recombined, which is followed by the joining of one $V_H$ gene segment forming a rearranged VDJ gene that encodes a VH chain. The rearrangement occurs only on a single heavy chain allele by the process of allelic exclusion. Allelic exclusion is regulated by in-frame or "productive" recombination of the VDJ segments, which occurs in only about one-third of VDJ recombinations of the variable heavy chain. When such productive recombination events first occur in a cell, this results in production of a μ heavy chain that gets expressed on the surface of a pre-B cell and transmits a signal to shut off further heavy chain recombination, thereby preventing expression of the allelic heavy chain locus. The surface-expressed μ heavy chain also acts to activate the kappa (κ) locus for rearrangement. The lambda (λ) locus is only activated for rearrangement if the κ recombination is unproductive on both loci. The light chain rearrangement events are similar to heavy chain, except that only the $V_L$ and $J_L$ segments are recombined. Before primary transcription of each, the corresponding constant chain gene is added. Subsequent transcription and RNA splicing leads to mRNA that is translated into an intact light chain or heavy chain.

The variable regions of antibodies confer antigen binding and specificity due to recombination events of individual germline V, D and J segments, whereby the resulting recombined nucleic acid sequences encoding the variable region domains differ among antibodies and confer antigen-specificity to a particular antibody. The variation, however, is limited to three complementarity determining regions (CDR1, CDR2, and CDR3) found within the N-terminal domain of the heavy (H) and (L) chain variable regions. The CDRs are interspersed with regions that are more conserved, termed "framework regions" (FR). The extent of the framework region and CDRs has been precisely defined (see e.g., Kabat, E. A. et al. (1991) *Sequences of Proteins of Immunological Interest*, Fifth Edition, U.S. Department of Health and Human Services, NIH Publication No. 91-3242, and Chothia, C. et al. (1987) *J. Mol. Biol.* 196:901-917). Each VH and VL is typically composed of three CDRs and four FRs arranged from the amino terminus to carboxy terminus in the following order: FR1, CDR1, FR2, CDR2, FR3, CDR3 and FR4. Sequence variability among VL and VH domains is generally limited to the CDRs, which are the regions that form the antigen binding site. For example, for the heavy chain, generally, $V_H$ genes encode the N-terminal three framework regions, the first two complete CDRs and the first part of the third CDR; the $D_H$ gene encodes the central portion of the third CDR, and the $J_H$ gene encodes the last part of the third CDR and the fourth framework region. For the light chain, the $V_L$ genes encode the first CDR and second CDR. The third CDR (CDRL3) is formed by the joining of the $V_L$ and $J_L$ gene segments. Hence, CDRs 1 and 2 are exclusively encoded by germline V gene segment sequences. The VH and VL chain CDR3s form the center of the Ag-binding site, with CDRs 1 and 2 form the outside boundaries; the FRs support the scaffold by orienting the H and L CDRs. On average, an antigen binding site typically requires that at least four of the CDRs make contact with the antigen's epitope, with CDR3 of both the heavy and light chain being the most variable and contributing the most specificity to antigen binding (see e.g., Janis Kuby, Immunology, Third Edition, New York, W.H. Freeman and Company, 1998, pp. 115-118). CDRH3, which includes all of the D gene segment, is the most diverse component of the Ab-binding site, and typically plays a critical role in defining the specificity of the Ab. In addition to sequence variation, there is variation in the length of the CDRs between the heavy and light chains (see Table 26 in Example 12).

The constant regions, on the other hand, are encoded by sequences that are more conserved among antibodies. These domains confer functional properties to antibodies, for example, the ability to interact with cells of the immune system and serum proteins in order to cause clearance of infectious agents. Different classes of antibodies, for example IgM, IgD, IgG, IgE and IgA, have different constant regions, allowing them to serve distinct effector functions.

These natural recombination events of V, D, and J, can provide nearly $2 \times 10^7$ different antibodies with both high affinity and specificity. Additional diversity is introduced by nucleotide insertions and deletions in the joining segments and also by somatic hypermutation of V regions. The result is that there are approximately $10^{10}$ antibodies present in an individual with differing antigen specificities.

The methods provided herein take advantage of the mechanisms responsible for generating diversity between and among germline antibodies, thereby permitting generation of collections of antibodies that can be tested for varied functional or other properties.

D. Methods of Generating Members of the Combinatorial Antibody Library

Provided herein are methods of producing combinatorial antibody libraries and the resulting libraries. Typically, each member in the library contains a variable heavy chain and a variable light chain, or portions thereof sufficient to form an antigen binding site. In the methods provided herein, each antibody member of the library is generated by mimicking natural recombination events by combining known V(D)J gene segment sequences (e.g. from publicly available databases of germline sequences), or modified forms thereof, in various permutations, in-frame, to generate a plurality of nucleic acid sequences encoding functional VH and VL chains. For example, in the steps of the methods nucleic acid molecules encoding the variable heavy (VH) chain are generated by recombining individual V, D and J segments. Nucleic acid molecules encoding the variable light (VL) chain are generated by recombining individual V (Vκ or Vλ) and J ($J_κ$, or $J_λ$) segments that make up the variable light chains. The segments can be germline segments, or degenerate sequences thereof. In such examples, the resulting antibodies produced by the method are naïve antibodies. It is contemplated herein, however, that the method can be performed using any modified form of a known germline segment, for example, to introduce further diversity into the library. For example, the method can be performed using reverse complement (i.e. inverted) sequences of $D_H$ germline segments. The process of recombining germline segments in-frame can be performed manually using molecular biology techniques or in silico (e.g. using a computer programmed to perform an algorithm).

In the methods, the recombination is effected so that each gene segment is in-frame, such that resulting recombined nucleic acid molecules encodes a functional VH or VL polypeptide. Also, in the methods, each nucleic acid molecule is individually generated and synthesized. In the methods, resulting members of the library are produced by co-expression of nucleic acid molecules encoding the recombined variable region genes together, such that when expressed, a combinatorial antibody member is generated minimally containing a VH and VL chain, or portions thereof. In some examples of the methods, the nucleic acid molecule encoding the VH and VL chain can be expressed as a single nucleic acid molecule, whereby the genes encoding the heavy and light chain are joined by a linker. In another example of the methods, the nucleic acid molecules encoding the VH and VL chain can be separately provided for expression together. Thus, upon expression from the recombined nucleic acid molecules, each different member of the library represents a germline encoded antibody, whereby diversity is achieved by combinatorial diversity of V(D)J segments and pairing diversity of heavy and light chains. In the method, additional diversity can be introduced into the library using any of a number of approaches known in the art, including but not limited to, random mutagenesis, semi-rational or rational mutagenesis.

One or more or all steps of the method can be performed in an addressable format, such that the identity of each member in the process is known by its location at an addressed locus. Hence, provided herein are addressable libraries of germline recombined nucleic acid sequences encoding VH chains, addressable libraries of germline recombined nucleic acid sequences encoding VL chains, and addressable libraries formed by combinations of nucleic acids molecules encoding VL chains and nucleic acid molecules encoding VH chains at each locus. Also provided are addressable cells, each cell at a locus containing different combinations of a recombined nucleic acid molecule encoding a VL and a recombined nucleic acid encoding a VH. Resulting antibody libraries also can be addressable. Such addressable antibody libraries permit rapid identification of "Hits" and assessment of structure/activity relationships between and among "Hits." The resulting libraries of antibodies can be screened for a variety of activities, such as but not limited to binding, proliferation, cytotoxicity and low affinity leads against difficult antigens, such as self antigens, ion channels, G-protein coupled receptors, novel epitopes, non-protein antigens and the discovery of agonist antibodies.

1. Methods for Producing Functional Recombined Germline Variable Region Genes

Provided herein is a method for generating nucleic acid molecules generated by recombination of germline segments or modified forms thereof, each nucleic acid molecule encoding a different and functional variable region of the heavy or light chains. Variable gene segments include $V_H$, $D_H$, $J_H$, $V_\kappa$, $J_\kappa$, $V_\lambda$ and $J_\lambda$. Germline segments can be selected from but not limited to human, mouse, rat, sheep, pig, goat horse, rabbit or dog germline segments. Exemplary germline segments are of human origin.

a. Variable Gene Segments
i. Germline Segments

In practicing the methods herein, germline segment sequences are obtained from any source that provides antibody germlines gene segments. These include any databases or published literature that sets forth sequences of germline gene segments. Exemplary antibody germline sources include but are not limited to databases at the National Center for Biotechnology Information (NCBI), the international ImMunoGeneTics information system® (IMGT), the Kabat database and the Tomlinson's VBase database (Lefranc (2003) *Nucleic Acids Res.*, 31:307-310; Martin et al., Bioinformatics Tools for Antibody Engineering in Handbook of Therapeutic Antibodies, Wiley-VCH (2007), pp. 104-107). If desired, nucleic acid sequences for non-human germline segments also can be obtained from published literature or publicly available databases. For example, an exemplary mouse germline databases is ABG database available at ibt.unam.mx/vir/v_mice.html. The Sequence Listing provided herein provides sequences of exemplary human germline segment sequences collected from the IMGT database and other public database (see e.g., SEQ ID NOS:10-451 and 868).

For example, exemplary human Heavy Chain Germline Segments (SEQ ID NO. 10-285) are listed in Table 3. Exemplary human Light Chain Kappa Germline Segments (SEQ ID NO.286-364 and SEQ ID NO. 868) are listed in Table 4. Exemplary human Light Chain Lambda Germline Segments (SEQ ID NO. 365-451) are listed in Table 5. Germline segments are listed using IMGT gene names and definitions previously approved by the Human Genome Organization (HUGO) nomenclature committee. The segments are named using IMGT nomenclature, whereby the first three letters indicate the locus (IGH, IGK or IGL), the fourth letter represents the gene (e.g., V for V-gene, D for D-gene, J for J-gene), the fifth position indicates the number of the subgroup, followed by a hyphen indicating the gene number classification. For alleles, the IMGT name is followed by an asterisk and a two figure number.

Tables 6-8 list alternative nomenclature for Human Heavy Chain V Genes, Human Light Chain Kappa V Genes, and Human Light Chain Lambda V Genes, respectively (see e.g. Lefranc, M.-P. *Exp Clin Immunogenet*, 18:100-116 (2001), Zachau, H. G. *Immunologist*, 4:49-54 (1996), Lefranc, M.-P. *Exp Clin Immunogenet*, 18:161-174 (2000), Kawasaki et al, *Genome Res*, 7:250-261 (1997), Lefranc, M.-P. *Exp Clin Immunogenet*, 18:242-254 (2001). Any desired naming convention can be used to identify antibody germline segments. One of skill in the art can identify a nucleic acid sequence using any desired naming convention. For purposes herein when describing recombined nucleic acid sequences (see e.g., Table 22), VH germline segments are named using IMGT nomenclature without any allele identified. Table 6 lists the IMGT nomenclature and corresponding IMGT nomenclature with the respective allele. VK germline segments are named using Zachau nomenclature. Table 7 lists the Zachau nomenclature and the corresponding IMGT nomenclature. VL germline segments are identified using Kawasaki nomenclature. Table 8 lists the Kawasaki nomenclature and the corresponding IMGT nomenclature. DH, JH, JK and JL germline segments are named using IMGT nomenclature.

TABLE 3

Human Heavy Chain Germline Segments

| SEQ ID NO. | V Segments |
|---|---|
| 10 | IGHV1-18*01 |
| 11 | IGHV1-18*02 |
| 12 | IGHV1-2*01 |
| 13 | IGHV1-2*02 |
| 14 | IGHV1-2*03 |
| 15 | IGHV1-2*04 |
| 16 | IGHV1-24*01 |
| 17 | IGHV1-3*01 |
| 18 | IGHV1-3*02 |
| 19 | IGHV1-45*01 |
| 20 | IGHV1-45*02 |
| 21 | IGHV1-45*03 |
| 22 | IGHV1-46*01 |
| 23 | IGHV1-46*02 |
| 24 | IGHV1-46*03 |

TABLE 3-continued

Human Heavy Chain Germline Segments

| SEQ ID NO. | |
|---|---|
| 25 | IGHV1-58*01 |
| 26 | IGHV1-58*02 |
| 27 | IGHV1-69*01 |
| 28 | IGHV1-69*02 |
| 29 | IGHV1-69*03 |
| 30 | IGHV1-69*04 |
| 31 | IGHV1-69*05 |
| 32 | IGHV1-69*06 |
| 33 | IGHV1-69*07 |
| 34 | IGHV1-69*08 |
| 35 | IGHV1-69*09 |
| 36 | IGHV1-69*10 |
| 37 | IGHV1-69*11 |
| 38 | IGHV1-69*12 |
| 39 | IGHV1-69*13 |
| 40 | IGHV1-8*01 |
| 41 | IGHV1-c*01 |
| 42 | IGHV1-f*01 |
| 43 | IGHV1-f*02 |
| 44 | IGHV2-26*01 |
| 45 | IGHV2-5*01 |
| 46 | IGHV2-5*02 |
| 47 | IGHV2-5*03 |
| 48 | IGHV2-5*04 |
| 49 | IGHV2-5*05 |
| 50 | IGHV2-5*06 |
| 51 | IGHV2-5*07 |
| 52 | IGHV2-5*08 |
| 53 | IGHV2-5*09 |
| 54 | IGHV2-5*10 |
| 55 | IGHV2-70*01 |
| 56 | IGHV2-70*02 |
| 57 | IGHV2-70*03 |
| 58 | IGHV2-70*04 |
| 59 | IGHV2-70*05 |
| 60 | IGHV2-70*06 |
| 61 | IGHV2-70*07 |
| 62 | IGHV2-70*08 |
| 63 | IGHV2-70*09 |
| 64 | IGHV2-70*10 |
| 65 | IGHV2-70*11 |
| 66 | IGHV2-70*12 |
| 67 | IGHV2-70*13 |
| 68 | IGHV3-11*01 |
| 69 | IGHV3-11*03 |
| 70 | IGHV3-13*01 |
| 71 | IGHV3-13*02 |
| 72 | IGHV3-13*02 |
| 73 | IGHV3-15*01 |
| 74 | IGHV3-15*02 |
| 75 | IGHV3-15*03 |
| 76 | IGHV3-15*04 |
| 77 | IGHV3-15*05 |
| 78 | IGHV3-15*06 |
| 79 | IGHV3-15*07 |
| 80 | IGHV3-15*08 |
| 81 | IGHV3-16*01 |
| 82 | IGHV3-16*02 |
| 83 | IGHV3-20*01 |
| 84 | IGHV3-21*01 |
| 85 | IGHV3-21*02 |
| 86 | IGHV3-23*01 |
| 87 | IGHV3-23*02 |
| 88 | IGHV3-23*03 |
| 89 | IGHV3-23*04 |
| 90 | IGHV3-23*05 |
| 91 | IGHV3-30*01 |
| 92 | IGHV3-30*02 |
| 93 | IGHV3-30*03 |
| 94 | IGHV3-30*04 |
| 95 | IGHV3-30*05 |
| 96 | IGHV3-30*06 |
| 97 | IGHV3-30*07 |
| 98 | IGHV3-30*08 |
| 99 | IGHV3-30*09 |
| 100 | IGHV3-30*10 |
| 101 | IGHV3-30*11 |
| 102 | IGHV3-30*12 |
| 103 | IGHV3-30*13 |
| 104 | IGHV3-30*14 |
| 105 | IGHV3-30*15 |
| 106 | IGHV3-30*16 |
| 107 | IGHV3-30*17 |
| 108 | IGHV3-30*18 |
| 109 | IGHV3-30*19 |
| 110 | IGHV3-30-3*01 |
| 111 | IGHV3-30-3*02 |
| 112 | IGHV3-33*01 |
| 113 | IGHV3-33*02 |
| 114 | IGHV3-33*03 |
| 115 | IGHV3-33*04 |
| 116 | IGHV3-33*05 |
| 117 | IGHV3-35*01 |
| 118 | IGHV3-38*01 |
| 119 | IGHV3-38*02 |
| 120 | IGHV3-43*01 |
| 121 | IGHV3-43*02 |
| 122 | IGHV3-48*01 |
| 123 | IGHV3-48*02 |
| 124 | IGHV3-48*03 |
| 125 | IGHV3-49*01 |
| 126 | IGHV3-49*02 |
| 127 | IGHV3-49*03 |
| 128 | IGHV3-49*04 |
| 129 | IGHV3-49*05 |
| 130 | IGHV3-53*01 |
| 131 | IGHV3-53*02 |
| 132 | IGHV3-53*03 |
| 133 | IGHV3-64*01 |
| 134 | IGHV3-64*02 |
| 135 | IGHV3-64*03 |
| 136 | IGHV3-64*04 |
| 137 | IGHV3-64*05 |
| 138 | IGHV3-66*01 |
| 139 | IGHV3-66*02 |
| 140 | IGHV3-66*03 |
| 141 | IGHV3-66*04 |
| 142 | IGHV3-7*01 |
| 143 | IGHV3-7*02 |
| 144 | IGHV3-72*01 |
| 145 | IGHV3-72*02 |
| 146 | IGHV3-73*01 |
| 147 | IGHV3-73*02 |
| 148 | IGHV3-74*01 |
| 149 | IGHV3-74*02 |
| 150 | IGHV3-74*03 |
| 151 | IGHV3-9*01 |
| 152 | IGHV3-d*0153 |
| 153 | IGHV4-28*01 |
| 154 | IGHV4-28*02 |
| 155 | IGHV4-28*03 |
| 156 | IGHV4-28*04 |
| 157 | IGHV4-28*05 |
| 158 | IGHV4-30-2*01 |
| 159 | IGHV4-30-2*02 |
| 160 | IGHV4-30-2*03 |
| 161 | IGHV4-30-2*04 |
| 162 | IGHV4-30-4*01 |
| 163 | IGHV4-30-4*02 |
| 164 | IGHV4-30-4*03 |
| 165 | IGHV4-30-4*04 |
| 166 | IGHV4-30-4*05 |
| 167 | IGHV4-30-4*06 |
| 168 | IGHV4-31*01 |
| 169 | IGHV4-31*02 |
| 170 | IGHV4-31*03 |
| 171 | IGHV4-31*04 |
| 172 | IGHV4-31*05 |
| 173 | IGHV4-31*06 |
| 174 | IGHV4-31*07 |

TABLE 3-continued

Human Heavy Chain Germline Segments

| SEQ ID NO. | |
|---|---|
| 175 | IGHV4-31*08 |
| 176 | IGHV4-31*09 |
| 177 | IGHV4-31*10 |
| 178 | IGHV4-34*01 |
| 179 | IGHV4-34*02 |
| 180 | IGHV4-34*03 |
| 181 | IGHV4-34*04 |
| 182 | IGHV4-34*05 |
| 183 | IGHV4-34*06 |
| 184 | IGHV4-34*07 |
| 185 | IGHV4-34*08 |
| 186 | IGHV4-34*09 |
| 187 | IGHV4-34*10 |
| 188 | IGHV4-34*11 |
| 189 | IGHV4-34*12 |
| 190 | IGHV4-34*13 |
| 191 | IGHV4-39*01 |
| 192 | IGHV4-39*02 |
| 193 | IGHV4-39*03 |
| 194 | IGHV4-39*04 |
| 195 | IGHV4-39*05 |
| 196 | IGHV4-39*06 |
| 197 | IGHV4-39*07 |
| | V, D, or J Segments |
| 198 | IGHV4-4*01 |
| 199 | IGHV4-4*02 |
| 200 | IGHV4-4*03 |
| 201 | IGHV4-4*04 |
| 202 | IGHV4-4*05 |
| 203 | IGHV4-4*06 |
| 204 | IGHV4-4*07 |
| 205 | IGHV4-59*01 |
| 206 | IGHV4-59*02 |
| 207 | IGHV4-59*03 |
| 208 | IGHV4-59*04 |
| 209 | IGHV4-59*05 |
| 210 | IGHV4-59*06 |
| 211 | IGHV4-59*07 |
| 212 | IGHV4-59*08 |
| 213 | IGHV4-59*09 |
| 214 | IGHV4-59*10 |
| 215 | IGHV4-61*01 |
| 216 | IGHV4-61*02 |
| 217 | IGHV4-61*03 |
| 218 | IGHV4-61*04 |
| 219 | IGHV4-61*05 |
| 220 | IGHV4-61*06 |
| 221 | IGHV4-61*07 |
| 222 | IGHV4-61*08 |
| 223 | IGHV4-b*01 |
| 224 | IGHV4-b*02 |
| 225 | IGHV5-51*01 |
| 226 | IGHV5-51*02 |
| 227 | IGHV5-51*03 |
| 228 | IGHV5-51*04 |
| 229 | IGHV5-51*05 |
| 230 | IGHV5-a*01 |
| 231 | IGHV5-a*03 |
| 232 | IGHV5-a*04 |
| 233 | IGHV6-1*01 |
| 234 | IGHV6-1*02 |
| 235 | IGHV7-4-1*01 |
| 236 | IGHV7-4-1*02 |
| 237 | IGHV7-4-1*03 |
| 238 | IGHV7-81*01 |
| | D Segments |
| 239 | IGHD1-1*01 |
| 240 | IGHD1-14*01 |
| 241 | IGHD1-20*01 |
| 242 | IGHD1-26*01 |
| 243 | IGHD1-7*01 |
| 244 | IGHD2-15*01 |

TABLE 3-continued

Human Heavy Chain Germline Segments

| SEQ ID NO. | |
|---|---|
| 245 | IGHD2-2*01 |
| 246 | IGHD2-2*02 |
| 247 | IGHD2-2*03 |
| 248 | IGHD2-21*01 |
| 249 | IGHD2-21*02 |
| 250 | IGHD2-8*01 |
| 251 | IGHD2-8*02 |
| 252 | IGHD3-10*01 |
| 253 | IGHD3-10*02 |
| 254 | IGHD3-16*01 |
| 255 | IGHD3-16*02 |
| 256 | IGHD3-22*01 |
| 257 | IGHD3-3*01 |
| 258 | IGHD3-3*02 |
| 259 | IGHD3-9*01 |
| 260 | IGHD4-11*01 |
| 261 | IGHD4-17*01 |
| 262 | IGHD4-23*01 |
| 263 | IGHD4-4*01 |
| 264 | IGHD5-12*01 |
| 265 | IGHD5-18*01 |
| 266 | IGHD5-24*01 |
| 267 | IGHD5-5*01 |
| 268 | IGHD6-13*01 |
| 269 | IGHD6-19*01 |
| 270 | IGHD6-25*01 |
| 271 | IGHD6-6*01 |
| 272 | IGHD7-27*01 |
| | J Segments |
| 273 | IGHJ1*01 |
| 274 | IGHJ2*01 |
| 275 | IGHJ3*01 |
| 276 | IGHJ3*02 |
| 277 | IGHJ4*01 |
| 278 | IGHJ4*02 |
| 279 | IGHJ4*03 |
| 280 | IGHJ5*01 |
| 281 | IGHJ5*02 |
| 282 | IGHJ6*01 |
| 283 | IGHJ6*02 |
| 284 | IGHJ6*03 |
| 285 | IGHJ6*04 |

TABLE 4

Human Light Chain Kappa Germline Segments

| SEQ ID NO. | |
|---|---|
| | V Segments |
| 286 | IGKV1-12*01 |
| 287 | IGKV1-12*02 |
| 288 | IGKV1-13*02 |
| 289 | IGKV1-16*01 |
| 290 | IGKV1-17*01 |
| 291 | IGKV1-17*02 |
| 292 | IGKV1-27*01 |
| 293 | IGKV1-33*01 |
| 294 | IGKV1-37*01 |
| 295 | IGKV1-39*01 |
| 296 | IGKV1-5*01 |
| 297 | IGKV1-5*02 |
| 298 | IGKV1-5*03 |
| 299 | IGKV1-6*01 |
| 300 | IGKV1-8*01 |
| 301 | IGKV1-9*01 |
| 302 | IGKV1-NL1*01 |
| 303 | IGKV1/OR2-0*01 |
| 304 | IGKV1/OR2-108*01 |

TABLE 4-continued

Human Light Chain Kappa Germline Segments

| SEQ ID NO. | |
|---|---|
| 305 | IGKV1D-12*01 |
| 306 | IGKV1D-12*02 |
| 307 | IGKV1D-13*01 |
| 308 | IGKV1D-16*01 |
| 309 | IGKV1D-16*02 |
| 310 | IGKV1D-17*01 |
| 311 | IGKV1D-33*01 |
| 312 | IGKV1D-37*01 |
| 313 | IGKV1D-39*01 |
| 314 | IGKV1D-42*01 |
| 315 | IGKV1D-43*01 |
| 316 | IGKV1D-8*01 |
| 317 | IGKV2-24*01 |
| 318 | IGKV2-28*01 |
| 319 | IGKV2-29*02 |
| 320 | IGKV2-29*03 |
| 321 | IGKV2-30*01 |
| 322 | IGKV2-40*01 |
| 323 | IGKV2-40*02 |
| 324 | IGKV2D-24*01 |
| 325 | IGKV2D-26*01 |
| 326 | IGKV2D-26*02 |
| 327 | IGKV2D-28*01 |
| 328 | IGKV2D-29*01 |
| 329 | IGKV2D-29*02 |
| 330 | IGKV2D-30*01 |
| 331 | IGKV2D-40*01 |
| 332 | IGKV3-11*01 |
| 333 | IGKV3-11*02 |
| 334 | IGKV3-15*01 |
| 335 | IGKV3-20*01 |
| 336 | IGKV3-20*02 |
| 337 | IGKV3-7*01 |
| 338 | IGKV3-7*02 |
| 339 | IGKV3-7*03 |
| 340 | IGKV3-NL1*01 |
| 341 | IGKV3-NL2*01 |
| | V or J Segments |
| 342 | IGKV3-NL3*01 |
| 343 | IGKV3-NL4*01 |
| 344 | IGKV3-NL5*01 |
| 345 | IGKV3/OR2-268*01 |
| 346 | IGKV3/OR2-268*02 |
| 347 | IGKV3D-11*01 |
| 348 | IGKV3D-15*01 |
| 349 | IGKV3D-20*01 |
| 350 | IGKV3D-7*01 |
| 351 | IGKV4-1*01 |
| 352 | IGKV5-2*01 |
| 353 | IGKV6-21*01 |
| 354 | IGKV6D-21*01 |
| 355 | IGKV6D-41*01 |
| 868 | IGKV1-39*02 |
| | J Segments |
| 356 | IGKJ1*01 |
| 357 | IGKJ2*01 |
| 358 | IGKJ2*02 |
| 359 | IGKJ2*03 |
| 360 | IGKJ2*04 |
| 361 | IGKJ3*01 |
| 362 | IGKJ4*01 |
| 363 | IGKJ4*02 |
| 364 | IGKJ5*01 |

TABLE 5

Human Light Chain Lambda Germline Segments

| SEQ ID NO. | |
|---|---|
| | V Segments |
| 365 | IGLV1-36*01 |
| 366 | IGLV1-40*01 |
| 367 | IGLV1-40*02 |
| 368 | IGLV1-40*03 |
| 369 | IGLV1-41*01 |
| 370 | IGLV1-44*01 |
| 371 | IGLV1-47*01 |
| 372 | IGLV1-47*02 |
| 373 | IGLV1-50*01 |
| 374 | IGLV1-51*01 |
| 375 | IGLV1-51*02 |
| 376 | IGLV10-54*01 |
| 377 | IGLV10-54*02 |
| 378 | IGLV10-54*03 |
| 379 | IGLV11-55*01 |
| 380 | IGLV2-11*01 |
| 381 | IGLV2-11*02 |
| 382 | IGLV2-11*03 |
| 383 | IGLV2-14*01 |
| 384 | IGLV2-14*02 |
| 385 | IGLV2-14*03 |
| 386 | IGLV2-14*04 |
| 387 | IGLV2-18*01 |
| 388 | IGLV2-18*02 |
| 389 | IGLV2-18*03 |
| 390 | IGLV2-18*04 |
| 391 | IGLV2-23*01 |
| 392 | IGLV2-23*02 |
| 393 | IGLV2-23*03 |
| 394 | IGLV2-33*01 |
| 395 | IGLV2-33*02 |
| 396 | IGLV2-33*03 |
| 397 | IGLV2-8*01 |
| 398 | IGLV2-8*02 |
| 399 | IGLV2-8*03 |
| 400 | IGLV3-1*01 |
| 401 | IGLV3-10*01 |
| 402 | IGLV3-10*02 |
| 403 | IGLV3-12*01 |
| 404 | IGLV3-12*02 |
| 405 | IGLV3-16*01 |
| 406 | IGLV3-19*01 |
| 407 | IGLV3-21*01 |
| 408 | IGLV3-21*02 |
| 409 | IGLV3-21*03 |
| 410 | IGLV3-22*01 |
| 411 | IGLV3-25*01 |
| 412 | IGLV3-25*02 |
| 413 | IGLV3-25*03 |
| 414 | IGLV3-27*01 |
| 415 | IGLV3-32*01 |
| 416 | IGLV3-9*01 |
| 417 | IGLV3-9*02 |
| 418 | IGLV4-3*01 |
| 419 | IGLV4-60*01 |
| 420 | IGLV4-60*02 |
| 421 | IGLV4-60*03 |
| 422 | IGLV4-69*01 |
| 423 | IGLV4-69*02 |
| 424 | IGLV5-37*01 |
| | V or J Segments |
| 425 | IGLV5-39*01 |
| 426 | IGLV5-39*02 |
| 427 | IGLV5-45*01 |
| 428 | IGLV5-45*02 |
| 429 | IGLV5-45*03 |
| 430 | IGLV5-48*01 |
| 431 | IGLV5-52*01 |
| 432 | IGLV6-57*01 |
| 433 | IGLV7-43*01 |
| 434 | IGLV7-46*01 |
| 435 | IGLV7-46*02 |

TABLE 5-continued

Human Light Chain Lambda Germline Segments

| SEQ ID NO. | |
|---|---|
| 436 | IGLV8-61*01 |
| 437 | IGLV8-61*02 |
| 438 | IGLV8-61*03 |
| 439 | IGLV9-49*01 |
| 440 | IGLV9-49*02 |
| 441 | IGLV9-49*03 |
| | J Segments |
| 442 | IGLJ1*01 |
| 443 | IGLJ2*01 |
| 444 | IGLJ3*01 |
| 445 | IGLJ3*02 |
| 446 | IGLJ4*01 |
| 447 | IGLJ5*01 |
| 448 | IGLJ5*02 |
| 449 | IGLJ6*01 |
| 450 | IGLJ7*01 |
| 451 | IGLJ7*02 |

TABLE 6

Human Heavy Chain V Genes

| IMGT Nomenclature | IMGT Nomenclature with alleles | SEQ ID No. |
|---|---|---|
| VH1-18 | IGHV1-18*01 | 10 |
| VH1-2 | IGHV1-2*02 | 13 |
| VH1-24 | IGHV1-24*01 | 16 |
| VH1-3 | IGHV1-3*02 | 18 |
| VH1-45 | IGHV1-45*02 | 20 |
| VH1-46 | IGHV1-46*01 | 22 |
| VH1-58 | IGHV1-58*02 | 26 |
| VH1-69 | IGHV1-69*06 | 32 |
| VH1-8 | IGHV1-8*01 | 40 |
| VH2-26 | IGHV2-26*01 | 44 |
| VH2-5 | IGHV2-5*01 | 45 |
| VH2-70 | IGHV2-70*13 | 67 |
| VH3-11 | IGHV3-11*01 | 68 |
| VH3-13 | IGHV3-13*01 | 70 |
| VH3-15 | IGHV3-15*01 | 73 |
| VH3-16 | IGHV3-16*02 | 82 |
| VH3-20 | IGHV3-20*01 | 83 |
| VH3-21 | IGHV3-21*01 | 84 |
| VH3-23 | IGHV3-23*01 | 86 |
| VH3-30 | IGHV3-30*03 | 93 |
| VH3-33 | IGHV3-33*01 | 112 |
| VH3-35 | IGHV3-35*01 | 117 |
| VH3-38 | IGHV3-38*02 | 119 |
| VH3-43 | IGHV3-43*01 | 120 |
| VH3-48 | IGHV3-48*02 | 123 |
| VH3-49 | IGHV3-49*03 | 127 |
| VH3-53 | IGHV3-53*01 | 130 |
| VH3-64 | IGHV3-64*02 | 134 |
| VH3-66 | IGHV3-66*03 | 140 |
| VH3-7 | IGHV3-7*01 | 142 |
| VH3-72 | IGHV3-72*01 | 144 |
| VH3-73 | IGHV3-73*02 | 147 |
| VH3-74 | IGHV3-74*01 | 148 |
| VH3-9 | IGHV3-9*01 | 151 |
| VH4-28 | IGHV4-28*01 | 153 |
| VH4-31 | IGHV4-31*02 | 169 |
| VH4-34 | IGHV4-34*01 | 178 |
| VH4-39 | IGHV4-39*01 | 191 |
| VH4-4 | IGHV4-4*07 | 204 |
| VH4-59 | IGHV4-59*01 | 205 |
| VH4-61 | IGHV4-61*08 | 222 |
| VH5-51 | IGHV5-51*03 | 227 |
| VH6-1 | IGHV6-1*01 | 233 |
| VH7-81 | IGHV7-81*01 | 238 |

TABLE 7

Human Light Chain Kappa V Genes

| Zachau Nomenclature | IMGT Nomenclature | SEQ ID No. |
|---|---|---|
| A1 | IGKV2D-30*01 | 330 |
| A10 | IGKV6D-21*01 | 354 |
| A11 | IGKV3D-20*01 | 349 |
| A14 | IGKV6D-41*01 | 355 |
| A17 | IGKV2-30*01 | 321 |
| A18b | IGKV2-29*02 | 319 |
| A19 | IGKV2-28*01 | 318 |
| A2 | IGKV2D-29*01 | 328 |
| A20 | IGKV1-27*01 | 292 |
| A23 | IGKV2-24*01 | 317 |
| A26 | IGKV6D-21*01 | 354 |
| A27 | IGKV3-20*01 | 335 |
| A3 | IGKV2D-28*01 | 327 |
| A30 | IGKV1-17*01 | 290 |
| A5 | IGKV2D-26*01 | 325 |
| A7 | IGKV2D-24*01 | 324 |
| B2 | IGKV5-2*01 | 352 |
| B3 | IGKV4-1*01 | 351 |
| L1 | IGKV1-16*01 | 289 |
| L10 | IGKV3-7*01 | 337 |
| L10a | IGKV3-7*02 | 338 |
| L11 | IGKV1-6*01 | 299 |
| L12 | IGKV1-5*01 | 296 |
| L12a | IGKV1-5*03 | 298 |
| L14 | IGKV1D-17*01 | 310 |
| L15 | IGKV1D-16*01 | 308 |
| L15a | IGKV1D-16*02 | 309 |
| L16 | IGKV3D-15*01 | 348 |
| L18 | IGKV1D-13*01 | 307 |
| L19 | IGKV1D-12*01 | 305 |
| L2 | IGKV3-15*01 | 334 |
| L20 | IGKV3D-11*01 | 347 |
| L22 | IGKV1D-42*01 | 314 |
| L23 | IGKV1D-43*01 | 315 |
| L24 | IGKV1D-8*01 | 316 |
| L25 | IGKV3D-7*01 | 350 |
| L4/18a | IGKV1-13*02 | 288 |
| L5 | IGKV1-12*01 | 286 |
| L6 | IGKV3-11*01 | 332 |
| L8 | IGKV1-9*01 | 301 |
| L9 | IGKV1-8*01 | 300 |
| O1 | IGKV2D-40*01 | 331 |
| O11 | IGKV2-40*01 | 322 |
| O11a | IGKV2-40*02 | 323 |
| O12 | IGKV1-39*01 | 295 |
| O12a | IGKV1-39*02 | 868 |
| O14 | IGKV1-37*01 | 294 |
| O18 | IGKV1-33*01 | 293 |
| O2 | IGKV1D-39*01 | 313 |
| O4 | IGKV1D-37*01 | 312 |
| O8 | IGKV1D-33*01 | 311 |
| Z0 | IGKV1/OR2-0*01 | 303 |

TABLE 8

Human Light Chain Lambda V Genes

| Kawasaki Nomenclature | IMGT Nomenclature | SEQ ID No. |
|---|---|---|
| V1-11 | IGLV1-36*01 | 365 |
| V1-13 | IGLV1-40*01 | 366 |
| V1-16 | IGLV1-44*01 | 369 |
| V1-17 | IGLV1-47*02 | 372 |
| V1-18 | IGLV1-50*01 | 373 |
| V1-19 | IGLV1-51*01 | 374 |
| V1-2 | IGLV2-8*01 | 397 |
| V1-20 | IGLV10-54*02 | 377 |
| V1-22 | IGLV6-57*01 | 432 |
| V1-3 | IGLV2-11*01 | 380 |
| V1-4 | IGLV2-14*01 | 383 |
| V1-5 | IGLV2-18*01 | 387 |

TABLE 8-continued

Human Light Chain Lambda V Genes

| Kawasaki Nomenclature | IMGT Nomenclature | SEQ ID No. |
|---|---|---|
| V1-7 | IGLV2-23*03 | 393 |
| V1-9 | IGLV2-33*01 | 394 |
| V2-1 | IGLV3-1*01 | 400 |
| V2-11 | IGLV3-16*01 | 405 |
| V2-13 | IGLV3-19*01 | 406 |
| V2-14 | IGLV3-21*02 | 408 |
| V2-15 | IGLV3-22*01 | 410 |
| V2-17 | IGLV3-25*02 | 412 |
| V2-19 | IGLV3-27*01 | 414 |
| V2-6 | IGLV3-9*01 | 416 |
| V2-7 | IGLV3-10*01 | 401 |
| V2-8 | IGLV3-12*02 | 404 |
| V3-2 | IGLV7-43*01 | 433 |
| V3-3 | IGLV7-46*02 | 435 |
| V3-4 | IGLV8-61*01 | 436 |
| V4-1 | IGLV5-37*01 | 424 |
| V4-2 | IGLV5-45*03 | 429 |
| V4-3 | IGLV5-48*01 | 430 |
| V4-4 | IGLV5-52*01 | 431 |
| V4-6 | IGLV11-55*01 | 379 |
| V5-1 | IGLV4-3*01 | 418 |
| V5-2 | IGLV9-49*2 | 440 |
| V5-4 | IGLV4-60*02 | 420 |
| V5-6 | IGLV4-69*01 | 422 | ii. Modified Germline Segments

It is contemplated herein that the practice of the method is not limited to germline segment sequences. Hence, any modified $V_H$, $D_H$, $J_H$, $V_\kappa$, $J_\kappa$, $V_\lambda$ and or $J_\lambda$ segment sequences, or any sequence analogous thereto, can be used in the practice of the method. By virtue of adding to the repertoire of segment sequences by modification thereto, the diversity of the library and the permutations of compiled segments can be further increased. The germline segments can be modified randomly or empirically. The germline segments can be modified to generate further diversity in the library. Alternatively or in addition, the germline segments can be modified to facilitate generation of the recombined full-length nucleic acid molecules by the introduction of linkers, restriction enzyme sites or other sequences of nucleotides required for practice of the method described herein.

Generally, the modified germline segments include those that are derived from germline sequences. The germline segments can be modified by introducing mutations into the germline sequence, randomly or empirically, or can be modified to generate germline consensus sequences. For example, modified $J_H$ germline segments are set forth in SEQ ID NOS: 3450-3455.

In another example, additional modifications of the germline segments include the addition of flanking sequences at one or both of the 5' and 3' termini of individual germline segments that provide restriction sites. Such modifications can be incorporated into the germline sequences using DNA synthesis, or by PCR, for example using primers that incorporate the restriction enzyme sites. In one example, as discussed below, the addition of such restriction sites facilitate joining of germline segments. In some cases, however, modifications of germline segments include the removal of restrictions sites. Restriction sites include any restriction site known in the art. Exemplary restriction site sequences are set forth in Table 15. Generally, the restriction site chosen is compatible with the subsequent compilation of germline segment sequences and can be chosen to facilitate blunt-ended ligation or sticky-ended ligation. The choice of restriction enzyme is routine and is well within the level of one of skill in the art.

In some examples, sequences of known antibodies, including monoclonal antibodies, particularly therapeutic antibodies, that are derived from germline sequences can be used in the methods herein. Since monoclonal antibodies already have a recognized antigen specificity, it is contemplated herein that incorporation of such derived sequences into the methods will permit the identification of antibodies with improved specificity and functionality against a target antigen. The nucleotide sequences derived from germline sequences, for example corresponding to any one or more of a $V_H$, $D_H$, $J_H$, $V_\kappa$, $J_\kappa$, $V_\lambda$ and or $J_\lambda$ can themselves be combined with germline segment sequences. One of skill in the art can identify the corresponding sequences in a nucleic acid molecule encoding a particular antibody that are derived from germline sequences. Table 9 below identifies V, D and J regions that correlate with the derived germline sequences.

TABLE 9

Exemplary Monoclonal Antibody Sequences (V regions, normal font; D regions, underlined; J regions, boldface)

| TARGET | ANTIBODY | HEAVY CHAIN SEQUENCE | Protein SEQ ID NO: | Nucleotide SEQ ID NO: |
|---|---|---|---|---|
| CD20 | Rituxan (rituximab) | QVQLQQPGAELVKPGASVKMSCKASGYTFTSYNMHW VKQTPGRGLEWIGAIYPGNGDTSYNQKFKGKATLTADK SSSTAYMQLSSLTSEDSAVYYCARSTYYGGDWYFNVW GAGTTVTVSA | 1027 | 1043 |
| EGFR | Erbitux (cetuximab | QVQLKQSGPGLVQPSQSLSITCTVSGFSLTNYGVHWV RQSPGKGLEWLGVIWSGGNTDYNTPFTSRLSINKDNSK SQVFFKMNSLQSNDTAIYYCARALTYYDYEFAYWGQG TLVTVSA | 1028 | 1044 |
| Her2/Neu | Herceptin (trastuzumab) | EVQLVESGGGLVQPGGSLRLSCAASGFNIKDTYIHWVR QAPGKGLEWVARIYPTNGYTRYADSVKGRFTISADTSK NTAYLQMNSLRAEDTAVYYCSRWGGDGFYAMDYWGQ GTLVTVSS | 1029 | 452 |
| VEGFA | Avastin (bevacizumab) | EVQLVESGGGLVQPGGSLRLSCAASGYTFTNYGMNW VRQAPGKGLEWVGWINTYTGEPTYAADFKRRFTFSLD | 1030 | 1045 |

TABLE 9-continued

Exemplary Monoclonal Antibody Sequences (V regions, normal font; D regions, underlined; J regions, boldface)

| TARGET | ANTIBODY | | Protein SEQ ID NO: | Nucleotide SEQ ID NO: |
|---|---|---|---|---|
| | | TSKSTAYLQMNSLRAEDTAVYYCAKYPHYYGSSHWYF DVWGQGTLVTVSS | | |
| VEGFA | Lucentis (ranibizumab) | EVQLVESGGGLVQPGGSLRLSCAASGYDFTHYGMNW VRQAPGKGLEWVGWINTYTGEPTYAADFKRRFTFSLD TSKSTAYLQMNSLRAEDTAVYYCAKYPYYYGTSHWYF DVWGQGTLVTVSS | 1031 | 1046 |
| CD52 | Campath (alemtuzumab) | QVQLQESGPGLVRPSQTLSLTCTVSGFTFTDFYMNWV RQPPGRGLEWIGFIRDKAKGYTTEYNPSVKGRVTMLVD TSKNQFSLRLSSVTAADTAVYYCAREGHTAAPFDYWG QGSLVTVSS | 1032 | 1047 |
| TNF | Humira (adalimumab) | EVQLVESGGGLVQPGRSLRLSCAASGFTFDDYAMHWV RQAPGKGLEWVSAITWNSGHIDYADSVEGRFTISRDNA KNSLYLQMNSLRAEDTAVYYCAKVSYLSTASSLDYWG QGTLVTVSS | 1033 | 1048 |
| EGFR | Vectibix (panitumumab) | QVQLQESGPGLVKPSETLSLTCTVSGGSVSSGDYYWT WIRQSPGKGLEWIGHIYYSGNTNYNPSLKSRLTISIDTS KTQFSLKLSSVTAADTAIYYCVRDRVTGAFDIWGQGTM VTSS | 1034 | 1049 |
| | | LIGHT CHAIN SEQUENCE | | |
| CD20 | Rituxan (rituximab) | QIVLSQSPAILSASPGEKVTMTCRASSSVSYIHWFQQKP GSSPKPWIYATSNLASGVPVRFSGSGSGTSYSLTISRV EAEDAATYYCQQWTSNPPTFGGGTKLEIK | 1035 | 1050 |
| EGFR | Erbitux (cetuximab | DILLTQSPVILSVSPGERVSFSCRASQSIGTNIHWYQQR TNGSPRLLIKYASESISGIPSRFSGSGSGTDFTLSINSVE SEDIADYYCQQNNNWPTTFGAGTKLELK | 1036 | 1051 |
| Her2/Neu | Herceptin (trastuzumab) | DIQMTQSPSSLSASVGDRVTITCRASQDVNTAVAWYQ QKPGKAPKLLIYSASFLYSGVPSRFSGSRSGTDFTLTIS SLQPEDFATYYCQQHYTTPPTFGQGTKVEIK | 1037 | 818 |
| VEGFA | Avastin (bevacizumab) | DIQMTQSPSSLSASVGDRVTITCSASQDISNYLNWYQQ KPGKAPKVLIYFTSSLHSGVPSRFSGSGSGTDFTLTISS LQPEDFATYYCQQYSTVPWTFGQGTKVEIK | 1038 | 1052 |
| VEGFA | Lucentis (ranibizumab) | DIQLTQSPSSLSASVGDRVTITCSASQDISNYLNWYQQK PGKAPKVLIYFTSSLHSGVPSRFSGSGSGTDFTLTISSL QPEDFATYYCQQYSTVPWTFGQGTKVEIK | 1039 | 1053 |
| CD52 | Campath (alemtuzumab) | DIQMTQSPSSLSASVGDRVTITCKASQNIDKYLNWYQQ KPGKAPKLLIYNTNNLQTGVPSRFSGSGSGTDFTFTISS LQPEDIATYYCLQHISRPRTFGQGTKVEIK | 1040 | 1054 |
| TNF | Humira (adalimumab) | DIQMTQSPSSLSASVGDRVTITCRASQGIRNYLAWYQQ KPGKAPKLLIYAASTLQSGVPSRFSGSGSGTDFTLTISS LQPEDVATYYCQRYNRAPYTFGQGTKVEIK | 1041 | 1055 |
| EGFR | Vectibix (panitumumab) | DIQMTQSPSSLSASVGDRVTITCQASQDISNYLNWYQQ KPGKAPKLLIYDASNLETGVPSRFSGSGSGTDFTFTISS LQPEDIATYFCQHFDHLPLAFGGGTKVEIK | 1042 | 1056 |

In some examples, the modified germline sequence can include a sequence of nucleotides that replaces all or some of the nucleotides of a germline segment. For example, it is further contemplated herein, that the modified germline sequences designated $D_H$ can be any sequence of nucleotides. The $D_H$ segment of a nucleic acid molecule encodes the central portion of the CDRH3 and is largely responsible for the antigen specificity and variability among antibodies. Since this region is the most variable among antibodies, it can tolerate more modification. Also, it is the region most responsible for antigen specificity. Generally, a segment designated $D_H$ includes 5, 10, 11, 12, 13, 14, 15, 16, 17, 18, 19, 20, 30, 40, 50, 60, 70, 80, 90, 100 or more nucleotides. The sequence of nucleotides is chosen such that once compiled, in-frame, with a $V_H$ and $J_H$ as discussed below, an antibody molecule or fragment or portion thereof is produced that contains a sufficient antigen-binding site. The nucleotides are chosen randomly or empirically. In some examples, a segment of nucleotides designated $D_H$ can include a random sequence of nucleotides. In other examples, the segment of nucleotides can be selected to be targeted against a specific antigen. For example, the segment of nucleotides can encode a peptide mimetic (see e.g. Table 16 below). In additional examples, a segment of nucleotides designated $D_H$ can include nucleotides that are the reverse complement (i.e. inverted) compared to a known $D_H$ germline segment. This is exemplified in Example 14.

In other examples, germline segment sequences can be modified to provide a consensus sequence between and among germline segments. Generally, due to the variability between and among the CDR regions, consensus sequences are generated in framework regions. Such modifications aid in the practice of the method by facilitating manipulation of a common sequence, for example, where the method of generating a combinatorial antibody library is performed manually. This is exemplified in Example 1 where each of the $J_H$ contain a common F4 framework region.

b. Choosing Germline Segments or Modified Segments thereof

As described herein above, each VH and VL chain is encoded by a nucleic acid molecule combinatorially generated from gene segments, generally germline segments or modified forms thereof. The members of the resulting library can be chosen by selecting, randomly or empirically, the gene segments that can be recombined. One of skill in the art can select any desired V(D)J gene segment or subsets thereof for recombination to generate in-frame nucleic acid molecules encoding VH or VL.

In one example, the germline V(D)J segment sequences can be recombined randomly, whereby all known germline sequences (e.g. any described in the Sequence Listing herein or any available in public databases or known to those of skill in the art, and any modified forms thereof) are recombined together in all possible permutations. In such an example, every $V_H$ gene segment is recombined with every $D_H$ which is recombined with every $J_H$. Similarly, every $V_L(_\kappa$ or $_\lambda)$ is recombined with every $J_L(_\kappa$ or $_\lambda)$. In such an example, the resulting recombined germline nucleic acid molecules represent the complete repertoire of naïve VH and VL. For example, if germline segments are recombined based on known germline segment sequences set forth in Tables 3-5, greater then or about 100,000 different recombined nucleic acid molecules encoding VH can be generated, greater then or about 600 different recombined nucleic acids encoding $VL_\kappa$ can be generated, and greater then or about 700 different recombined nucleic acid molecules encoding $VL_\lambda$ can be generated. Thus, libraries of nucleic acids encoding variable heavy and light chains provided herein can encode for every possible recombined antibody variable region. In addition, further diversity can be introduced by modification, such as by mutagenesis, by introducing directed peptides, or by using inverted $D_H$ sequences, as described herein above.

Alternatively, the V(D)J segments can be recombined using rational or semi-rational approaches such that a specific germline segment sequence or subset of sequences used are restricted in generating the members of the library. For example, as described in Example 14 herein, all members of the library contain a $V_H$ germline segment that is an IGHV3-23*01. In other examples, germline segment sequences can be selected that contain modifications, for example, those that contain mutations to a specific region or region generated randomly (e.g. by site-directed mutagenesis to a particular CDR) or empirically (e.g. modified to contain directed peptide mimetics). By permitting selection of germline segment sequences, the libraries provided herein are versatile and can be rationally designed based on the application of the library.

For example, antibody germline segments can be selected wherein the resulting nucleic acid sequences are restricted based on sequence similarities or differences or other shared characteristics. For example, germline segment sequences can be selected based on sequence similarities or differences or based on shared characteristics (e.g., a V region family, length, CDR3 length or composition, species, functionality, specificity, group, subgroup, pattern within the CDR, specific amino acids or other biochemical attribute). Antibody structure databases (e.g. CATH database: available at cathwww.biochem.ucl.ac.uk/; SACS database: available at bioinf.org.uk/abs/sacs/; IMGT 3D structure database: available at imgt3d.igh.cnrs.fr/) or other databases are available to sort germline segments based on a selected criteria. Alternatively, such selection can be done manually, for example, using sequence alignments or other manual sorting.

In one example, germline segments can be selected based on their sequence similarity or differences. One of skill in the art knows or can determine the sequence identity between and among germline segments, and identify germline segments that have a particular sequence identity. In one example, germline segment sequences from one or more of a $V_H$, $D_H$, $J_H$, $V_\kappa$, $J_\kappa$, $V_\lambda$ and or $J_\lambda$ group can be selected based on sequence similarity. Sequence similarity between selected segments can include, but is not limited to, 60%, 70%, 75%, 80%, 85%, 90%, 91%, 92%, 93%, 94%, 95%, 96%, 97%, 98%, 99% or more. For example, subsets of germline segment belonging to the same subgroup or gene family can be selected, which generally share a high degree (e.g. greater then 70%, typically 75% or more) sequence identity. Tables 3-5 above identify germline segments belonging to the same subgroup or gene family. For example, in Table 3, IGHV1, IGHV2, IGHV3, IGHV4, IGHV5, IGHV6 and IGHV7 each represent a subgroup of a VH segment, and germline segments within a subgroup share at least 75% sequence identity. Thus, all germline segments in the IGHV1 can be selected, or all germline segments in IGHV2 can be selected, or all germline segments in IGHV3 can be selected, etc. In another example, in Table 3 IGHV1-18*01 and IGHV1-18*02 represent a gene family having germline segments that are alleles. Thus, all germline segments that are related by virtue of being in the same family can be selected as a subset of germline sequences.

In another example, germline segments can be selected based on sequence differences so that the resulting subset represents a diverse repertoire of sequences. One of skill in the art knows or can identify germline segments that have a particular sequence identity. Sequence differences between selected segments can include those that exhibit 60%, 50%, 40%, 30%, 25%, 20%, 15%, 10%, or less sequence similarity. For example, subsets of germline segments, each from a different subgroup can be selected. Thus, in one example, VH segments can be selected from each of the IGHV1, IGHV2, IGHV3, IGHV4, IGHV5, IGHV6 and IGHV7 subgroups; for example, a subset can include IGHV1-18*01, IGHV1-26*01, IGHV3-11*01, IGHV4-28*01, IGHV6-1*01, IGHV7-4-1*03. In another example, a VH segment can be selected from each gene family; for example, a subset can include IGHV1-18*01, IGHV1-2*01, IGHV1-3*01, IGHV1-45*01, IGHV1-46*01, IGHV1-58*01, IGHV1-69*01, IGHV1-8*01, IGHV1-c*01, IGHV1-f*01, IGHV2-26*01, IGHV2-5*01, IGHV2-70*01, IGHV3-11*01, IGHV3-13*01, IGHV3-15*01, IGHV3-16*01, IGHV3-20*01, IGHV3-21*01, IGHV3-23*01, IGHV3-30*01, IGHV3-33*01, IGHV3-38*01, IGHV3-43*01, IGHV3-48*01, IGHV3-49*01, IGHV3-53*01, IGHV3-64*01, IGHV3-66*01, IGHV3-7*01, IGHV3-72*01, IGHV3-73*01, IGHV3-74*01, IGHV3-9*01; IGHV4-28*01, IGHV4-30-2*01, IGHV4-31*01, IGHV4-34*01, IGHV4-39*01, IGHV4-59*01, IGHV4-61*01, IGHV5-51*01, IGHV6-1*01 and IGHV7-4-1*01. One of skill of the art is able to select any subset of germline sequences as desired based on sequence differences.

Subsets for other germline segments sequences also can be selected based on sequence differences. Tables 10-12 sets forth exemplary selected $V_H$, $D_H$, $J_H$, $V_\kappa$, $J_\kappa$, $V_\lambda$ and or $J_\lambda$ germline segments representing selection of at least one germline segment from each gene family.

TABLE 10

Selected Human Heavy Chain Germline Segments

| | SEQ ID NO. |
|---|---|
| V Segments | |
| IGHV1-18*01 | 10 |
| IGHV1-2*02 | 13 |
| IGHV1-24*01 | 16 |
| IGHV1-3*02 | 18 |
| IGHV1-45*02 | 20 |
| IGHV1-46*01 | 22 |
| IGHV1-58*02 | 26 |
| IGHV1-69*06 | 32 |
| IGHV1-8*01 | 40 |
| IGHV2-26*01 | 44 |
| IGHV2-5*01 | 45 |
| IGHV2-70*13 | 67 |
| IGHV3-11*01 | 68 |
| IGHV3-13*01 | 70 |
| IGHV3-15*01 | 73 |
| IGHV3-16*02 | 82 |
| IGHV3-20*01 | 83 |
| IGHV3-21*01 | 84 |
| IGHV3-23*01 | 86 |
| IGHV3-30*03 | 93 |
| IGHV3-35*01 | 117 |
| IGHV3-38*02 | 119 |
| IGHV3-43*01 | 120 |
| IGHV3-48*02 | 123 |
| IGHV3-49*03 | 127 |
| IGHV3-53*01 | 130 |
| V or D Segments | |
| IGHV3-64*02 | 134 |
| IGHV3-66*03 | 140 |
| IGHV3-7*01 | 142 |
| IGHV3-72*01 | 144 |
| IGHV3-73*02 | 147 |
| IGHV3-74*01 | 148 |
| IGHV3-9*01 | 151 |
| IGHV4-28*01 | 153 |
| IGHV4-31*02 | 169 |
| IGHV4-34*01 | 178 |
| IGHV4-39*01 | 191 |
| IGHV4-4*07 | 204 |
| IGHV4-59*01 | 205 |
| IGHV5-51*03 | 227 |
| IGHV6-1*01 | 233 |
| IGHV7-81*01 | 238 |
| D Segments | |
| IGHD1-1*01 | 239 |
| IGHD1-14*01 | 240 |
| IGHD1-20*01 | 241 |
| IGHD1-26*01 | 242 |
| IGHD1-7*01 | 243 |
| IGHD2-15*01 | 244 |
| IGHD2-2*01 | 245 |
| IGHD2-21*01 | 248 |
| IGHD2-8*01 | 250 |
| D or J Segments | |
| IGHD3-10*01 | 252 |
| IGHD3-16*01 | 254 |
| IGHD3-22*01 | 256 |
| IGHD3-3*01 | 257 |
| IGHD3-9*01 | 259 |
| IGHD4-11*01 | 260 |
| IGHD4-17*01 | 261 |
| IGHD4-23*01 | 262 |
| IGHD4-4*01 | 263 |

TABLE 10-continued

Selected Human Heavy Chain Germline Segments

| | SEQ ID NO. |
|---|---|
| IGHD5-12*01 | 264 |
| IGHD5-18*01 | 265 |
| IGHD5-24*01 | 266 |
| IGHD5-5*01 | 267 |
| IGHD6-13*01 | 268 |
| IGHD6-19*01 | 269 |
| IGHD6-25*01 | 270 |
| IGHD6-6*01 | 271 |
| IGHD7-27*01 | 272 |
| J Segments | |
| IGHJ1*01 | 273 |
| IGHJ2*01 | 274 |
| IGHJ3*01 | 275 |
| IGHJ4*01 | 277 |
| IGHJ5*01 | 280 |
| IGHJ6*01 | 282 |

TABLE 11

Human Light Chain Kappa Germline Segments Selected for Manual Compilation

| | SEQ ID NO. |
|---|---|
| V Segments | |
| IGKV2D-30*01 | 330 |
| IGKV2-30*01 | 321 |
| IGKV2D-29*01 | 328 |
| IGKV1-27*01 | 292 |
| IGKV2-24*01 | 317 |
| IGKV6D-21*01 | 354 |
| IGKV3-20*01 | 335 |
| IGKV1-17*01 | 290 |
| IGKV5-2*01 | 352 |
| IGKV4-1*01 | 351 |
| IGKV1-6*01 | 299 |
| IGKV1-5*01 | 296 |
| IGKV1D-17*01 | 310 |
| IGKV3-15*01 | 334 |
| IGKV1D-42*01 | 314 |
| IGKV1D-43*01 | 315 |
| IGKV3D-7*01 | 350 |
| IGKV1-13*02 | 288 |
| IGKV1-12*01 | 286 |
| IGKV3-11*01 | 332 |
| V or J Segments | |
| IGKV1-9*01 | 301 |
| IGKV1-8*01 | 300 |
| IGKV2D-40*01 | 331 |
| IGKV1-39*01 | 295 |
| IGKV1-33*01 | 293 |
| J Segments | |
| IGKJ1*01 | 356 |
| IGKJ2*01 | 357 |
| IGKJ3*01 | 361 |

TABLE 12

Human Light Chain Lambda Germline Segments Selected for Manual Compilation

| | SEQ ID NO. |
|---|---|
| V Segments | |
| IGLV1-36*01 | 365 |
| IGLV1-40*01 | 366 |

TABLE 12-continued

Human Light Chain Lambda Germline Segments Selected for Manual Compilation

| | SEQ ID NO. |
|---|---|
| IGLV1-44*01 | 369 |
| IGLV1-50*01 | 373 |
| IGLV2-8*01 | 397 |
| IGLV10-54*02 | 377 |
| IGLV6-57*01 | 432 |
| IGLV2-11*01 | 380 |
| IGLV2-14*01 | 383 |
| IGLV2-18*01 | 387 |
| IGLV2-23*03 | 393 |
| IGLV2-33*01 | 394 |
| IGLV3-1*01 | 400 |
| J Segments | |
| IGLV3-16*01 | 405 |
| IGLV3-19*01 | 406 |
| IGLV3-21*02 | 408 |
| IGLV3-22*01 | 410 |
| IGLV3-25*02 | 412 |
| IGLV3-27*01 | 414 |
| IGLV3-9*01 | 416 |
| IGLV3-10*01 | 401 |
| IGLV3-12*02 | 404 |
| IGLV7-43*01 | 433 |
| IGLV7-46*02 | 435 |
| IGLV8-61*01 | 436 |
| IGLV5-37*01 | 424 |
| IGLV5-45*03 | 429 |
| IGLV5-48*01 | 430 |
| IGLV5-52*01 | 431 |
| IGLV11-55*01 | 379 |
| IGLV4-60*02 | 420 |
| IGLV4-69*01 | 422 |
| IGLJ1*01 | 442 |
| IGLJ2*01 | 443 |
| IGLJ4*01 | 446 |
| IGLJ5*01 | 447 |
| IGLJ6*01 | 449 |
| GLJ7*01 | 450 |

In all of the examples above, selection of germline segments based on sequence similarity or differences or other characteristics can be restricted for only one group of germline segments (from among any of $V_H$, $D_H$, $J_H$, $V_\kappa$, $J_\kappa$, $V_\lambda$ and or $J_\lambda$), 2 groups, 3 groups, 4 groups, 5 groups, 6 groups or all 7 groups. Thus, for example, in recombining the gene segments to encode for a plurality of VH chains, only the $V_H$ germline segment sequences can be restricted based on sequence similarity or differences or other characteristic, and the $D_H$ and $J_H$ segment sequences can represent all known $D_H$ and $J_H$ germline segment sequences. In another example, each of the $V_H$, $D_H$ and $J_H$ segment sequences can be selected based on sequence similarity or differences or other characteristic, thereby resulting in a restricted subset of germline segment sequences for compilation herein. In yet another example, in recombining the gene segments to encode for a plurality of VH chains, the $D_H$ segment is restricted based on its modification to include nucleotides encoding a particular peptide mimetic or mimetics against a target. In such an example, the $V_H$ and $J_H$ segment sequences can represent all known germline segment sequences to be recombined with the restricted subset of $D_H$ (e.g. modified) segment. The choice of germline segments selected for use in the compilation method provided herein depends on a variety of factors including, but not limited to, the diversity of the resulting library, knowledge regarding preference for a particular germline segment sequence for a target from an initial screen of a library (as described herein below under Section G.4 entitled iterative screening), and the size of the library.

c. Sequence Compilation

In the methods provided herein, the variable gene segment sequences are recombined to generate heavy chain variable regions (5'-$V_H D_H J_H$-3'), kappa light chain variable regions (5'-$V_\kappa J_\kappa$-3'), and lambda light chain variable regions (5'-$V_\lambda J_\lambda$-3') as described below. The gene segments can be recombined to generate full-length variable regions, or variable regions that are less then full length (i.e. portion thereof of full length), so long as the portion is sufficient to form an antigen binding site when expressed. The nucleic acid sequences are combined so that the resulting nucleic acid molecule is in-frame and encodes a functional VH or VL polypeptide, i.e. a full-length polypeptide or a portion thereof that is sufficient to form an antigen binding site.

The compilation method provided herein can be implemented by any procedures known to one of skill in the art. For example, it can be implemented manually, in silico (e.g. through computer software) or combinations thereof. In some examples, as described elsewhere herein below, the method can be implemented using sequence compilation software. In addition, public databases, such as those providing germline segment sequences or other public bioinformatics tools can be use to aid practice of the method.

Generally, full length heavy chain variable regions (5'-$V_H D_H J_H$-3'), or portions thereof, are recombined such that a $V_H$ segment is combined with a $D_H$ segment which is combined with a $J_H$ segment. Heavy chain segments are always combined such that the $V_H$ segment is 5' to the $D_H$ segment which is 5' to the $J_H$ segment. The exact $V_H D_H J_H$ can be chosen randomly or empirically and can represent germline segments, or modified forms thereof as discussed above. It is understood that when the method is performed manually using molecular biology techniques, restriction enzymes can be added to the ends of germline segments to facilitate joining of segments. Hence, in some examples, the resulting VH chain can contain additional amino acids between germline segments. For example, as described in the examples herein, nucleic acid molecule library members encoding a VH chain can encode sequences that contain amino acids SY at 5'end of the $J_H$ region between the joined $D_H$ region.

In one example of the methods herein, all permutations of $V_H D_H J_H$ gene segments can be recombined to generate a nucleic acid molecule encoding a variable heavy chain. Thus, every $V_H$ segment (e.g., set forth in any of SEQ ID NOS:10-238), is combined with every $D_H$ segment (e.g., any set forth in SEQ ID NOS: 239-272), which is combined with every $J_H$ segment (e.g. any set forth in SEQ ID NOS: 273-285). In such an example, based on the exemplary heavy chain germline segments set forth in Table 3, greater then or about 100,000 nucleic acid molecules encoding a variable heavy (VH) chain can be generated. In other examples, the $V_H D_H J_H$ gene segments can be recombined empirically (e.g. using rational or semi-rational approaches as discussed below). For example, as discussed below any subset of $V_H$, $D_H$ and/or $J_H$ gene segment can be chosen to generate a recombined nucleic acid molecule. In some examples, individual gene segments are selected because of a shared characteristic including, but not limited to, diversity, same V region family, CDR3 length, composition or other biochemical attribute.

Full length kappa light chain variable regions (5'-$V_\kappa J_\kappa$-3'), or portions thereof, are recombined such that a $V_\kappa$ segment is combined with a $J_\kappa$ segment. Full length lambda light chain variable regions (5'-$V_\lambda J_\lambda$-3') are recombined such that a $V_\lambda$ segment is combined with a $J_\lambda$ segment. Light chain segments are always combined such that the $V_L$ segment is 5' to the $J_L$ segment. The exact $V_\kappa J_\kappa$ or $V_\lambda J_\lambda$ can be chosen randomly or empirically and can represent germline segments, or modified forms thereof as discussed above. It is understood that when the method is performed manually using molecular biology techniques, restriction enzymes can be added to the ends of germline segments to facilitate joining of segments. Hence, in some examples, the resulting VL chain can contain additional amino acids between germline segments.

In one example of the methods herein, all permutations of $V_\kappa J_\kappa$ can be recombined to generate a nucleic acid molecule encoding a variable kappa light chain. Thus, every $V_\kappa$ (e.g. any set forth in SEQ ID NOS:286-355, 868) is combined with every $J_\kappa$ (e.g. any set forth in SEQ ID NOS: 356-364). In such an example, based on the exemplary kappa light chain germ line segments set forth in Table 4, greater then or about 600 nucleic acid molecules encoding a variable kappa light chain can be generated. In another example, all permutations of $V_\lambda J_\lambda$ can be recombined to generate a nucleic acid molecule encoding a variable lambda light chain. Thus, every $V_\lambda$ (e.g. any set forth in any of SEQ ID NOS:365-441) is combined with every $J_\lambda$ (e.g. any set forth in any of SEQ ID NOS: 442-451). In such an example, based on the exemplary lambda light chain germline segment set forth in Table 5, greater then or about 700 nucleic acid molecules encoding a variable lambda light chain can be generated. In another example, the $V_\kappa J_\kappa$ or $V_\lambda J_\lambda$ gene segments can be recombined empirically as described herein below.

In all of the examples above, recombined segments are joined such that the recombined full length nucleic acid is in frame with the 5' start codon (ATG), thereby allowing expression of a full length polypeptide. Any combination of a V(D)J can be made, and junctions modified accordingly in order to generate a compiled V(D)J sequence that is in-frame, while preserving reading frames of each segment. The choice of junction modification is a function of the combination of V(D)J that will be joined, and the proper reading frame of each gene segment. For example, any of the variable gene segments can exist in reading frame 1, 2 or 3 when compiled. Generally, however, for the practice of the method herein, the V sequence ($V_H$, $V_\kappa$ or $V_\lambda$) is always reading frame 1. Also, the reading frame of the J sequence is set to be either reading frame 1, 2 or 3 such that the resulting gene segment encodes the correct amino acids. Table 13 below sets forth the reading frames of the exemplary J germline sequences.

TABLE 13

J Germline Segment Sequences in Coding Frames

| | SEQUENCE | SEQ ID NO |
|---|---|---|
| Heavy | | |
| IGHJ1*01 | GCT AAA TAC TTC CAG CAC TGG GGC CAG GGC ACC CTG GTC ACC GTC TCC TCA G | 273 |
| IGHJ2*01 | C TAC TGG TAC TTC GAT CTC TGG GGC CGT GGC ACC CTG GTC ACT GTC TCC TCA G | 274 |
| IGHJ3*01 | T GAT GCT TTT GAT GTC TGG GGC CAA GGG ACA ATG GTC ACC GTC TCT TCA G | 275 |
| IGHJ3*02 | T GAT GCT TTT GAT ATC TGG GGC CAA GGG ACA ATG GTC ACC GTC TCT TCA G | 276 |
| IGHJ4*01 | AC TAC TTT GAC TAC TGG GGC CAA GGA ACC CTG GTC ACC GTC TCC TCA G | 277 |
| IGHJ4*02 | AC TAC TTT GAC TAC TGG GGC CAG GGA ACC CTG GTC ACC GTC TCC TCA G | 278 |
| IGHJ4*03 | GC TAC TTT GAC TAC TGG GGC CAA GGG ACC CTG GTC ACC GTC TCC TCA G | 279 |
| IGHJ5*01 | AC AAC TGG TTC GAC TCC TGG GGC CAA GGA ACC CTG GTC ACC GTC TCC TCA G | 280 |
| IGHJ5*02 | AC AAC TGG TTC GAC CCC TGG GGC CAG GGA ACC CTG GTC ACC GTC TCC TCA G | 281 |
| IGHJ6*01 | AT TAC TAC TAC TAC TAC GGT ATG GAC GTC TGG GGG CAA GGG ACC ACG GTC ACC GTC TCC TCA G | 282 |
| IGHJ6*02 | AT TAC TAC TAC TAC TAC GGT ATG GAC GTC TGG GGC CAA GGG ACC ACG GTC ACC GTC TCC TCA | 283 |
| IGHJ6*03 | AT TAC TAC TAC TAC TAC ATG GAC GTC TGG GGC AAA GGG ACC ACG GTC ACC GTC TCC TCA | 284 |
| IGHJ6*04 | AT TAC TAC TAC TAC TAC GGT ATG GAC GTC TGG GGC AAA GGG ACC ACG GTC ACC GTC TCC TCA G | 285 |
| Light Kappa | | |
| IGKJ1*01 | G TGG ACG TTC GGC CAA GGG ACC AAG GTG GAA ATC AAA C | 356 |
| IGKJ2*01 | TG TAC ACT TTT GGC CAG GGG ACC AAG CTG GAG ATC AAA C | 357 |
| IGKJ2*02 | G TGC ACT TTT GGC CAG GGG ACC AAG CTG GAG ATC AAA C | 358 |
| IGKJ2*03 | TG TAC AGT TTT GGC CAG GGG ACC AAG CTG GAG ATC AAA C | 359 |
| IGKJ2*04 | TG TGC AGT TTT GGC CAG GGG ACC AAG CTG GAG ATC AAA C | 360 |
| IGKJ3*01 | A TTC ACT TTC GGC CCT GGG ACC AAA GTG GAT ATC AAA C | 361 |
| IGKJ4*01 | G CTC ACT TTC GGC GGA GGG ACC AAG GTG GAG ATC AAA C | 362 |

TABLE 13-continued

J Germline Segment Sequences in Coding Frames

| | SEQUENCE | SEQ ID NO |
|---|---|---|
| IGKJ4*02 | G CTC ACG TTC GGC GGA GGG ACC AAG GTG GAG ATC AAA C | 363 |
| IGKJ5*01 | G ATC ACC TTC GGC CAA GGG ACA CGA CTG GAG ATT AAA C | 364 |
| Light Lambda | | |
| IGLJ1*01 | T TAT GTC TTC GGA ACT GGG ACC AAG GTC ACC GTC CTA G | 442 |
| IGLJ2*01 | T GTG GTA TTC GGC GGA GGG ACC AAG CTG ACC GTC CTA G | 443 |
| IGLJ3*01 | T GTG GTA TTC GGC GGA GGG ACC AAG CTG ACC GTC CTA G | 444 |
| IGLJ3*02 | T TGG GTG TTC GGC GGA GGG ACC AAG CTG ACC GTC CTA G | 445 |
| IGLJ4*01 | T TTT GTA TTT GGT GGA GGA ACC CAG CTG ATC ATT TTA G | 446 |
| IGLJ5*01 | C TGG GTG TTT GGT GAG GGG ACC GAG CTG ACC GTC CTA G | 447 |
| IGLJ5*02 | C TGG GTG TTT GGT GAG GGG ACG GAG CTG ACC GTC CTA G | 448 |
| IGLJ6*01 | T AAT GTG TTC GGC AGT GGC ACC AAG GTG ACC GTC CTC G | 449 |
| IGLJ7*01 | T GCT GTG TTC GGA GGA GGC ACC CAG CTG ACC GTC CTC G | 450 |
| IGLJ7*02 | T GCT GTG TTC GGA GGA GGC ACC CAG CTG ACC GCC CTC G | 451 |

For the heavy chain, the reading frame of the D variable gene segment sequence chosen is less rigid then for the V or J germline segments. This is because the D gene sequence is responsible for encoding the central portion of the CDRH3, which plays a prominent role in antigen specificity. Hence, variation of amino acids is expected in the D gene segment sequence. Thus, for example, the $D_H$ gene segment can be any $D_H$ gene segment in any reading frame, an inverted or reverse complement thereof, or a modified form thereof, or any sequence of nucleotides designated as the $D_H$. In some examples, however, the reading frame of the D germline sequence is chosen so that the resulting encoded amino acids are predominately hydrophilic. CDR3 is an antigen-binding site, and thereby is rich in hydrophilic residues that are surface exposed (see e.g., Zanetti and Billetta, Antigenized Antibodies from Concepts to Applications (1996), In The Antibodies, Volume 2 (pp. 75-122), Harwood Academic Publishers; Pommie et al. (2004) J Mol. Recognition, 17:17-32). One of skill in the art is familiar with techniques to assess the hydrophobicity/hydrophilicity of sequences. For example, hydrophilicity can be measured using protein grand average of hydropathy (GRAVY), which gives hydropathy value for a sequence by adding the hydropathy value for each residue and dividing by the length of the sequence (see e.g., Kyte and Doolittle (1982 and bioinformatics.org/sms2/protein_gravy.html). The lower the GRAVY value, the more hydrophilic a sequence is.

In some instances, compilation of variable gene segments in-frame, while preserving reading frames, requires no manipulation, i.e. no modification of joint regions. In other instances, however, simply compiling V(D)J sequences does not conserve reading frames. Thus, where the junctions between gene segments are not in the desired frame, modifications are made to nucleotides within the junctions between the segments so that each gene segment is in its desired reading frame, and the full length sequence is in-frame. Nucleic acid modifications include replacements or substitutions, insertions, or deletions of nucleotides, or any combination thereof. For example, at the V-D junction, one or more nucleotide can be deleted from the 5' end of the D, one or more nucleotide can be deleted from the 3' end of the V or one or more nucleotides can be inserted between the V and D (e.g. a nucleotide can be added to the 3' end of the V). In another example, at the D-J junction, one or more nucleotides can be deleted from the 5' end of the J, one or more nucleotides can be deleted from the 3' end of the D, or one or more nucleotides can be inserted between the D and J (e.g., a nucleotide can be added to the 3' end of the D). In a further example, at the V-J junction, as occurs in generation of a light chain, one or more nucleotides can be deleted from the 5' end of the J, one or more nucleotides can be deleted from the 3' end of the V or one or more nucleotides can be inserted between the V and J (e.g. a nucleotide can be added to the 3' end of the V). In such examples where nucleotides are inserted, any nucleotide insertion from among one or more of a guanine (G), adenine (A), cytosine (C) and thymine (T) is contemplated. In some examples, guanine (G) is chosen as the inserted nucleotide because of the slight preference of terminal deoxynucleotidyl transferase (TdT) for guanine residues (Alt et al. 1982).

In the methods, heavy chain segments are recombined separately from light chain gene segment sequences. Thus, an individual nucleic acid molecule encodes for either a heavy chain (VH) or a light chain (VL) variable region. In the methods, a plurality of VH nucleic acid molecules encoding a VH chain and a plurality of nucleic acid molecules encoding a VL chain are generated. The number of such sequences can be up to all possible permutations depending on the number of V, D or J gene segments available for combination. For example, where all known germline segment sequences are used for practice of the method, a fully naïve antibody library is generated. In other examples, modified gene segments can also be used for practice of the method. Alternatively, the number of permutations is a function of the selected V, D and J, which can be a subset of all germline segments or modified forms thereof.

Once a nucleic acid sequence is compiled, it is further modified to remove stop codons so that the resulting molecule is functional, i.e. encodes a polypeptide that is not truncated early. For example, modifications to remove stop codons include substitutions of nucleotides. Exemplary of such modifications, include, but are not limited to, stop codon TAA replaced by codons TAT; stop codon TAG replaced by codons TAT, and stop codon TGA replaced by codons TCA.

d. Further Sequence Modification of Recombined Nucleic Acid Sequences As discussed above, germline segment sequences can be modified before performing compilation as described herein. In addition or alternatively, modification can be made directly to the recombined nucleic acid sequence. Hence, it is understood that any of the modifications described below also can be made to individual germline segment sequences before compilation so long as the reading frames are maintained and the rules governing compilation as described herein are observed to generate in-frame recombined nucleic acid sequences.

Thus, any of the plurality of recombined nucleic acids encoding a VH chain or a VL chain can be further modified. Modifications of the nucleic acid sequences include replacements or substitutions, insertions, or deletions of nucleotides, or any combination thereof. Any modification contemplated by one of skill in the art can be made to the nucleic acid molecule, so long as the modification(s) do not interfere with or alter the junction joints made to maintain reading frames of the V(D)J segments achieved by virtue of practice of the method (as discussed in the Section entitled "Sequence Compilation" above). Any modification should be checked to confirm that all reading frames are intact to ensure that the resulting full length nucleic acid is in frame with the 5' start codon (ATG) thereby allowing expression of a full length VH or VL polypeptide, or a portion thereof that is sufficient to form an antigen binding site.

The resulting recombined germline variable heavy and light chain nucleic acid sequences can be further modified through DNA synthesis (i.e. modifications introduced upon synthesis of the nucleic acid molecule) or by using standard molecular biology techniques. Thus, in one example, any desired modification contemplated can be made to a nucleic acid molecule encoding a recombined variable heavy or variable light chain and the resulting nucleic acid molecule including any modifications synthesized as described in sub-section e.iii below. Due to the degeneracy of the genetic code nucleic acid sequences can be designed to avoid unwanted nucleotide sequences, including unwanted restriction sites, splicing donor or acceptor sites, or other nucleotide sequences potentially detrimental to efficient translation. Additionally, organisms sometimes favor particular codon usage and/or a defined ratio of GC to AT nucleotides. Thus, degeneracy of the genetic code permits design of nucleic acid sequences tailored for expression in particular organisms or groups of organisms. Additionally, nucleic acid molecules can be designed for different levels of expression based on optimizing (or non-optimizing) of the sequences. In another example, generated recombined germline VH and VL nucleic acid molecules as described in sub-section e.iii below, can be further modified using using standard molecular biology techniques, such as PCR, site-directed mutagenesis, restriction enzyme digestion, ligation, cloning and any combination thereof. The choice of whether to generate such modifications during DNA synthesis or using molecular biology techniques is dependent on the end user and can be influenced by factors such as the purpose of the modification, the extent of the modification and timing considerations.

Modifications of recombined germline nucleic acid molecules encoding VH or VL can be generated randomly or empirically. For example, random mutation of one or more regions can increase diversity of the library, particularly where modifications are made to any of the CDR-loop regions, which contribute to the specificity and affinity of the antibody. This library with increased diversity permits the generation of antibodies, derivatives thereof or portions or fragments thereof, which potentially can bind to any desired antigen with a high affinity. In another example, modifications can be empirically generated using rational or semi-rational approaches. Among such empirical modifications of nucleic acid molecules encoding VH and VL chains contemplated herein include, but are not limited to, modifications of the CDR regions, for example for the generation of directed libraries, modifications to optimize codon usage, and/or modifications to introduce restriction sites or detectable moieties. Modifications also can include a combinations of random and empirical modifications.

i. Codon Usage

For example, nucleic acid sequences can be modified to adapt the codon usage for expression such as, for example, bacterial expression. Codon usage is degenerate in that multiple codons encode for the same amino acid. Thus a single amino acid is therefore encoded by multiple codons, however within any organism, codon usage varies for any given amino acid. The full length nucleic acids provided herein are modified to replace rare codons with more abundant codons utilized in the particular expression system. Typically, modifications include silent mutations, such that the substitutions do not alter the specificity of the codon. Codon usage tables are known to those of skill in the art, particularly for common expression systems. For example, for expression in bacteria *E. coli* K12, codon usage Tables are known (see, e.g., Grantham, R. et al., *Nuc. Acids Res.*, 8:1892-1912 (1980); Grantham, R. et al., *Nuc. Acids Res.*, 9:r43-r74 (1981) and also Table 14). The codon usage table lists all of the sixty four possible three nucleotide codons for DNA or RNA with their frequency of usage in the bacteria *E. coli* K12. The Table shows that while a single amino acid is encoded by multiple codons (redundancy), these codons are not used at the same rate for any given amino acid. For example, the amino acid arginine is coded for by six different codons: CGT, CGC, CGA, CGG, AGA and AGG. The codon AGA has a frequency of 2.0% while the codon CGC has a frequency of 22%.

TABLE 14

Codon Usage in *E. coli* K12
fields: [triplet] [frequency: per thousand] ([number])

| | | | |
|---|---|---|---|
| TTT 22.2 (30361) | TCT 8.4 (11498) | TAT 16.1 (22071) | TGT 5.1 (7020) |
| TTC 16.6 (22649) | TCC 8.6 (11804) | TAC 12.2 (16734) | TGC 6.4 (8787) |
| TTA 13.8 (18915) | TCA 7.1 (9706) | TAA 2.0 (2752) | TGA 0.9 (1261) |
| TTG 13.6 (18601) | TCG 8.9 (12156) | TAG 0.2 (321) | TGG 15.2 (20835) |
| CTT 11.0 (15043) | CCT 7.0 (9554) | CAT 12.9 (17656) | CGT 21.0 (28700) |
| CTC 11.1 (15183) | CCC 5.4 (7448) | CAC 9.7 (13329) | CGC 22.0 (30159) |
| CTA 3.9 (5303) | CCA 8.4 (11518) | CAA 15.3 (20970) | CGA 3.5 (4787) |

TABLE 14-continued

Codon Usage in E. coli K12
fields: [triplet] [frequency: per thousand] ([number])

| | | | |
|---|---|---|---|
| CTG 52.9 (72403) | CCG 23.3 (31869) | CAG 28.9 (39560) | CGG 5.4 (7320) |
| ATT 30.4 (41551) | ACT 8.9 (12197) | AAT 17.7 (24192) | AGT 8.7 (11917) |
| ATC 25.2 (34426) | ACC 23.5 (32101) | AAC 21.7 (29656) | AGC 16.1 (21961) |
| ATA 4.3 (5827) | ACA 7.0 (9564) | AAA 33.7 (46044) | AGA 2.0 (2783) |
| ATG 27.8 (38012) | AGC 14.4 (19743) | AAG 10.3 (14043) | AGG 1.1 (1533) |
| GTT 18.3 (25079) | GCT 15.3 (20863) | GAT 32.2 (44103) | GGT 24.9 (34009) |
| GTC 15.3 (20913) | GCC 25.6 (35018) | GAC 19.2 (26201) | GGC 29.8 (40725) |
| GTA 10.9 (14885) | GCA 20.2 (27638) | GAA 39.7 (54267) | GGA 7.9 (10817) |
| GTG 26.3 (35960) | GCG 33.8 (46222) | GAG 17.8 (24414) | GGG 11.0 (15116) | ii. Adding or Removing Restriction Enzyme Sites

In another example, additional modifications of the nucleic acids include the addition of flanking sequences at one or both of the 5' and 3' termini of recombined VH or VL nucleic acid sequences that provide restriction sites. Such modifications can be incorporated into the germline recombined nucleic acid molecules during DNA synthesis, or by PCR, for example using primers that incorporate the restriction enzyme sites. In some examples, addition of such restriction sites facilitates cloning of the nucleic acids into a selected vector. For example, restriction sites include any restriction site known in the art. Exemplary restriction site sequences are set forth in Table 15. Generally, the restriction site chosen is compatible with the expression vector and can be chosen to facilitate blunt-ended ligation or sticky-ended ligation. The choice of restriction enzyme is routine and is well within the level of one of skill in the art.

TABLE 15

Common Restriction Enzyme Cleavage Recognition Sites

| Restriction Enzyme | Cleavage Sequence | SEQ ID NO |
|---|---|---|
| NcoI | CCATGG | 977 |
| NheI | GCTAGC | 978 |
| AvrII | CCTAGG | 979 |
| BsiWI | CGTACG | 980 |
| SfiI | GGCCNNNNNGGCC | 1889 |
| NotI | GCGGCCGC | 1890 |
| HindIII | AAGCTT | 1891 |
| EcoRI | GAATTC | 1892 |
| BamHI | GGATCC | 1893 |
| EcoRV | GATATC | 1894 |
| PstI | CTGCAG | 1895 |
| SalI | GTCGAC | 1896 |
| SmaI | CCCGGG | 1897 |
| XmaI | CCCGGG | 1898 |
| BglI | GCCNNNNNGGC | 1899 |
| MfeI | CAATTG | 1900 |
| BsaI | GGTCTCN | 3719 |

In some examples, nucleic acids can be modified to remove any restriction sites that occur within the nucleic acid sequence. In particular, removal of restriction sites is desired so that such sites do not interfere with subsequent digestion, ligation and cloning procedures. For example, as discussed above, recombined nucleic acid molecules can be modified to contain terminal flanking restriction sites to facilitate cloning into expression vectors. Generally, such restriction sites are chosen to be unique so that the presence of the site exists only at the terminal flanking end(s). If the site is not unique, modifications can be made to the sequence of the nucleic acid molecule to remove any conflicting restriction sites. One of skill in the art is familiar with restriction sites and can identify such sites within a nucleic acid sequence. Table 15 lists exemplary restriction sites that can be removed.

In some instances, a single nucleotide change is possible to effect change of the restriction site. In other instances, two or three nucleotide changes are necessary to remove a restriction site. Typically, modification of restriction sites existing internally in a recombined nucleic acid molecule are made in view of the codon usage as discussed above. For example, if a Sal I restriction sites (GTCGAC; SEQ ID NO:1896) exists internally in a nucleic acid molecule, the GTC codon that codes for valine (V) can be modified to GTA, GTG, GTT or GTC codons. Simply changing the last C to G correlates to changing the GTC codon (15.3% frequency of usage) to GTG (26.3% frequency of usage), which is an 11% increase in frequency of codon usage. Alternatively, the GAC codon (19.2% frequency of usage) that codes for asparagine (D) can be modified to GAT (32.2% frequency of usage) by changing the last C to T, which is a 13% increase in codon usage. In this example, either of the above modifications can be made. Typically, modifications are made to convey the highest absolute beneficial increase in frequency of codon usage.

iii. Linkers

In additional examples, nucleic acid molecules can be modified with a linker sequence. For example, where a single-chain antibody is desired (e.g. an scFv antibody) the variable heavy and light chains can first be joined by a linker. The linkage can be direct or via a linker. For example, nucleic acids encoding peptide linkers can be added during DNA synthesis or using molecular biology techniques to the 5' end of a first sequence (e.g. variable heavy chain) and the 3' terminus of a second nucleic acid sequence (e.g. variable light chain). Typically, the linker is of sufficient length so that the resulting polypeptide is soluble. Nucleic acid sequences for use as linkers can encode peptide linkers from about 2 or 2 to about 60 or 60 amino acid residues, for example from about 5 to 40, or from about 10 to 30, 2 to 6, 7, or 8 amino acid residues. Examples of known linker moieties include, but are not limited to, peptides, such as $(Gly_m Ser)n$ and $(Ser_m Gly)n$, in which n is 1 to 6, including 1 to 4 and 2 to 4, and m is 1 to 6, including 1 to 4, and 2 to 4. Exemplary of such linkers include any that encode peptide linkers such as glycine serine polypeptides, such as -Gly-Gly-, GGGGG (SEQ ID NO:981), GGGGS (SEQ ID NO:982) or (GGGGS)n (SEQ ID NO:985), SSSSG (SEQ ID NO:983) or (SSSSG)n (SEQ ID NO:1996). Linking moieties are described, for example, in Huston et al. (1988) PNAS 85:5879-5883, Whitlow et al. (1993) Protein Engineering 6:989-995, and Newton et al., (1996) Biochemistry 35:545-553. Other suitable linkers include any encoding a peptide linker, such as any of those described in U.S. Pat. Nos. 4,751,180 or 4,935,233, which are hereby incorporated by reference. A polynucleotide encoding a desired peptide linker can be inserted anywhere in variable heavy or light chain sequence or at the 5'- or 3'-terminus, in frame, using any suitable conventional technique. For example, restriction sites can be added to the 5' terminus of the heavy chain sequence and to the 3' terminus of the light chain sequence while a nucleic acid encoding a linker segment (e.g. $(Gly_4Ser)_3$; SEQ ID NO:984) can be added to the 3' terminus of the heavy chain sequence connecting it to the 5' terminus of the light chain sequence. Upon expression, such a nucleic acid molecule encodes an scFv antibody where the heavy chain variable region is operably linked to the light chain variable region.

iv. Tags or Detectable Moieties

Additionally, a small epitope tag, such as a myc tag, His tag, Flag tag or other small epitope tag, and/or any other additional DNA sequence can be added for incorporation into a nucleic acid sequence encoding a variable heavy chain or variable light chain (Arnau et al. (2006) Protein Expression and Purification, 48:1-13). In some instances, for example, a tag that permit attachment, for example, an LPETG tag, can be added that allows for site specific modification using the protein ligase, sortase (Chan et al. (2007) PLoS ONE, 2:e1164). Hence, inclusion of such a tag permits immobilization (e.g. on a BIAcore chip) and/or selective sorting in the presence of a sortase. Generally, the additional DNA sequence is added to the 3' or 5' terminus of the nucleic acid molecule encoding the recombined variable sequence directly or indirectly using a linker. Alternatively, the additional DNA sequence can be included in the expression vector of choice, such that, upon expression, the resulting antibody contains the additional sequence. For example, plasmid A set forth in SEQ ID NO:1 contains a His-Flag Tag corresponding to nucleotides 3265-3306 (Flag corresponds to nucleotides 3265-3288; His corresponds to nucleotides 3289-3306). In another example, Plasmid D set forth in SEQ ID NO: 2 contains a Flag tag corresponding to nucleotides 3265-3288, an LPETG tag corresponding to nucleotides 3289-3303. Thus, upon expression of the heavy chains, alone or together with a variable light chain, resulting antibodies can be detected using anti-Flag or anti-His tag reagents. This is described in Example 10. One of skill in the art can add any desired detectable sequence or other identifiable moiety to a nucleic acid molecule encoding a recombined variable heavy or light chain sequence to facilitate identification and/or purification of the resulting antibodies.

v. Mutational Diversity

In other examples, modifications can be made to introduce mutational diversity into the resulting nucleic acid molecules. Any modification can be made, such as by replacement, substitution, deletion or addition of amino acids, either randomly or empirically (i.e. into any region or segment of the recombined nucleic acid molecule). The modifications can be made during DNA synthesis or using routine molecular biology techniques such as site-directed mutagenesis, digestion with restriction enzymes and/or cloning.

For example, modification(s) can be introduced into a nucleic acid molecule encoding the VH chain, a nucleic acid molecule encoding the VL chain, or both. The modification(s) can be introduced in the region of one or more of CDR1, CDR2, CDR3, FR1, FR2, FR3 or FR4. For example, modifications can be introduced into one, two or all three of the three CDRs of a given variable domain (VH, VL or both). In one example, modifications are introduced into CDR1 and CDR2, e.g. of a heavy chain variable domain. Typically, modification(s) are introduced into the CDR3 of the heavy chain (CDRH3). Any combination is contemplated. One of skill in the art knows and can identify CDR1, CDR2, CDR3, FR1, FR2, FR3 and FR4 regions in a nucleic acid molecule encoding a VH or VL (see e.g., Chothia et al. (1989) Nature 342:877-883; Al-Lazikani et al. (1997) J Mol. Biol., 273:927-948); WO/2007/137616; bioinf.org.uk/abs/; bioc.unizh.ch/antibody/Numbering/NumFrame.html; Martin et al., Bioinformatics Tools for Antibody Engineering in Handbook of Therapeutic Antibodies, Wiley-VCH (2007), pp. 96-103). For example, CDRs can be identified in VH and VL chains using Kabat numbering based on sequence alignment or the Chothia numbering scheme based on structural topology. Since the Kabat numbering scheme was developed from sequence alignment, insertions in the sequence relative to the numbering scheme by alignment are indicated by letters (e.g. 27, 27A, 27B, 27C, etc. . . . ) and deletions have the corresponding number skipped. The residues corresponding to the six CDRs of the light and heavy chains based on Kabat numbering are CDR-L1: L24-L34; CDR-L2: L50-L56; CDR-L3: L89-L97; CDR-H1; H31-H35B; CDR-H2: H50-H65; CDR-H3: H95-H102. One of skill in the art knows that CDR lengths can vary and can identify corresponding residues, for example, by alignment and use of kabat numbering.

vi. Directed Peptides

In some cases, modifications include rationally generated modifications to generate antibodies and portions or fragments thereof that mimic the activity of biologically active peptides against known targets (see e.g., International published PCT Application No. WO 2004/050017). Important biological functions, such as receptor binding, activation and enzymatic activity, are often attributable to discrete regions of larger protein molecules, containing a limited number of amino acid residues termed peptide epitopes and mimitopes. These peptide epitopes and mimitopes can be used as therapeutics, but due to their small size, are typically unstable in vivo due to rapid degradation. The peptide epitopes, however, can be introduced into variable regions of antibodies, which can act to mimic the activity of the biologically active peptide. Such antibodies are more stable, and exhibit increased half-life. Thus, antibodies or portions thereof can be directed toward a known target or function by incorporating sequences into the variable regions of an antibody that correspond to a polynucleotide target of interest. Often, structure and/or function information of the known targets is available. These libraries are useful in providing lead antibodies for future antibody libraries.

Hence, included in the modifications herein are nucleic acid sequences encoding germline recombined VH and VL, wherein nucleotides corresponding to one or more CDR is replaced with nucleotides encoding one or more amino acid residues for a peptide of choice. In one example, the modifications in a nucleic acid molecule encoding a germline recombined VH and/or VL can be generated during DNA synthesis. Alternatively, the modification can be introduced into a nucleic acid molecule encoding a germline recombined VH and/or VL by restriction digestion followed by ligation with a peptide of choice. If necessary, restriction sites can be created in a CDR, such as by site-directed mutagenesis or PCR, to facilitate ligation of the peptide. This latter method is described in Example 12 herein.

The nucleotides can encode for peptides of 1, 2, 3, 4, 5, 6, 7, 8, 9, 10, 16, 20, 25 or more amino acids. Any peptide that exhibits a useful property is suitable for insertion into an antibody scaffold. Generally, the peptide is one that specifically binds a target molecule. The peptides also include those that exhibit a specific activity, for example, an agonist or antagonist activity upon binding to the target. Peptide activities and uses include, but are not limited to, binding a receptor, binding a membrane bound surface molecule, binding a ligand, binding an enzyme or structural protein, activating or inhibiting a receptor, target drug delivery or any enzymatic activity. Exemplary of peptides are those that bind to a cell surface receptor such as a receptor for a cytokine, growth factor or growth inhibitor. Peptide mimetics for incorporation into a recombined germline VH or VL include any set forth in U.S. Pat. Nos. 7,169,905; 7,396,917, 7,272,508, 7,019,017; U.S. published Patent Appl. No. US200701344; published International Appl. No. WO2005060642; Johnson et al. (2000) Nephrol Dial. Transplant, 15:1274-1277. Exemplary of such peptides are set forth in Table 16. Other peptides for incorporation into the VH and VL encoded by the recombined germline nucleic acids provided herein are known in the art (see e.g., any of the references cited above) and/or can be identified depending on the desired target.

TABLE 16

Exemplary Peptide Mimetics

| Peptide | Sequence | SEQ ID NO: |
|---|---|---|
| TPO | IEGPTLRQWLAARA | 987 |
| | GGCADGPTLREWISFCGGK | 988 |
| | GGCADGPTLREWISFCGG | 989 |
| | LAI EGPTLRQWLHGNGRDT | 990 |
| | GNADGPTLRQWLEGRRPKN | 991 |
| | TIKGPTLRQWLKSREHTS | 992 |
| EPO | TYSCHFGPLTWVCKPQ | 891 |
| | DYHCRMGPLTWVCKPLGG | 993 |
| | GGTYSCHFGPLTWVCKPQGG | 994 |
| | DREGCRRGWVGQCKAWFN | 995 |
| | QRVEILEGRTECVLSNLRGRTRY | 996 |
| G-CSF | EEDCK | 997 |
| IL-5 | TGGGDGYVCVEWARCPTCK | 998 |
| | EGYVCVEWAACPTCR | 999 |
| human brain natriuretic peptide (hBNP-32) | CFGRKMDRISSSSGLGC | 1000 |
| | FGRKMDRISSSSGLG | 1001 |
| Exendin 4 | HGEGRFTSDLSKQMEEEAVRLFIEWLKNGGPSSGAPPPS | 1002 |
| GLP-1 | HAEGTFTSDVSSYLEGQMKEFIAWLVKGR | 1003 |
| GLP-2 | HADGSFSDEMNTILDNLAARDFINWLIQTKITDR | 1004 |
| Glucagon | HSQGTFTSDYSKYLDSRRAQDRVQWLMNT | 1005 |
| PACAP-38 | HSDGIFTDSYSRYRKQMAVKKYLAAVLGKRYKQRVKNK | 1006 |
| CD209L | RYWNSGEPNNSGNEDCAEFSGSGWNCNRCDVDN | 1007 |
| TNF | YCFTASENHCY | 1008 |
| | YCFTNSENHCY | 1009 |
| VEGF | VEPNCDIHVMWEWECFERL | 1010 |
| | GERWCFDGPLTWVCGEES | 1011 |
| MMP inhibitor | CTTHWGFTLC | 1012 |

TABLE 16-continued

Exemplary Peptide Mimetics

| Peptide | Sequence | SEQ ID NO: |
|---|---|---|
| CTLA-4 | CSLHWGFWWC | 1013 |
|  | GFVCSGIFAVGVGRC | 1014 |

Nucleic acid molecules encoding for recombined germline VH or VL can be modified by replacement or introduction of nucleotides encoding a peptide into one or more of CDR1, CDR2, CDR3, FR1, FR2, FR3 or FR4. For example, nucleic acid molecules encoding for recombined germline VH or VL can be modified by replacement of an entire CDR with nucleotides encoding a peptide. The CDR replaced by a peptide can be CDRH1, CDRH2, CDRH3, CDRL1, CDRL2, and/or CDRL3. For example, in the resulting VH or VL chain one or more CDRs is replaced by a peptide. The peptides can be the same or different. In another example, nucleic acid molecules encoding for recombined human germline VH and VL are modified by replacement of a portion of a CDR with nucleotides encoding a peptide. The portion of the CDR replaced by the nucleotides is a portion of CDRH1, CDRH2, CDRH3, CDRL1, CDRL2, and/or CDRL3. The portion of the CDR replaced by the nucleotides can encode for a peptide that is 1, 2, 3, 4, 5, 6, 7, 8, 9, 10, 16, 20 or 25 or more amino acids. In an additional example, one or more portions of two or more CDRs are replaced by nucleotides encoding a peptide. The resulting peptides can be the same or different. In a further example, nucleic acid molecules encoding for recombined human germline VH or VL can be modified by insertion of nucleotides encoding a peptide between two nucleotides of a CDR of the antibody. The CDR with a peptide inserted is CDRH1, CDRH2, CDRH3, CDRL1, CDRL2, and/or CDRL3. In some instances, the resulting VH or VL chain includes one or more peptides inserted in one or more CDRs. The peptides inserted into the CDRs can be the same or different.

The addition of flanking sequences at the carboxy or N-terminal ends of a peptide have been shown to increase biological activity, by altering the presentation of the peptide within the antibody scaffold. Hence, nucleic acid molecules can be modified to encode peptides having adding flanking sequences at the carboxy or N-terminal ends of the peptides. Flanking sequences can encode for 1, 2, 3, 4, 5 or more amino acids. Flanking sequences can encode for any amino acid or any combinations of amino acids. Glycine is the smallest and simplest of the amino acids, containing only a single hydrogen atom in its side chain. Due to its small size, glycine can fit into small spaces and can adopt particular conformations that other amino acids can not. Proline is a sterically constrained amino acid that has been shown to increase activity of a peptide when flanking the peptide sequence (REF). Generally, flanking sequences encode for glycine or proline. Typically, flanking sequences encode for proline. For example, a nucleic acid molecule can encode a peptide containing proline and/or glycine added to the N- or C-terminus of the EPO peptide set forth in SEQ ID NO:891. Exemplary of nucleic acid molecules containing flanking sequences encode any of the EPO peptides set forth in SEQ ID NOS: 874-895.

e. Generating Variable Heavy and Light Chain Sequences and Nucleic Acid Molecules The sequences for recombined nucleic acid molecules encoding VH and VL chain compiled by practice of the method herein are collected and stored. The collected sequences can be analyzed for any particular characteristic, such as for example, sequence similarity between and among other recombined sequences. The sequences then can be ranked based on sequence diversity. All recombined sequences, or a subset thereof, can be generated into recombined nucleic acid molecules using DNA synthesis and/or recombinant DNA technology. For example, a subset of sequences can be selected based on their sequence similarity or difference for generation of an antibody library.

i. Storage and Collection

Sequences recombined by the method herein are collected and stored. Typically, collection and storage is in an addressable format, such that the identity of each sequence is known by its locus. For example, the sequences can be stored in a database or in a list. Further, the individual gene segment components of each nucleic acid sequence are known, and the recombined nucleic acid sequence identified by the component segments. For example, a nucleic acid sequence named VH1-18_IGHD1-26*01_IGHJ2*01 identifies a nucleic acid sequence encoding a variable heavy chain containing the VH germline segment VH1-18 (also called VH1-18*01 by some nomenclature standards), the DH germline segment IGHD1-26*01, and the JH germline segment IGHJ2*01. One of skill in the art can identify a nucleic acid sequence using any desired naming convention, so long as the component segments are easily identified.

Generally sequences encoding VH chains are recombined, collected and stored separately from VL chains. Further, among VL chains, sequences encoding V-kappa light chains are recombined, collected and stored separate from sequences encoding V-lambda chains. The identity of the nucleic acid sequence at each locus is known and can be mapped to an output file that contains the sequences for all the nucleic acid molecules within the addressable format.

For purposes herein, the sequences are addressably stored such that each sequence can be easily identified, including by its component parts (e.g. the individual compiled segments). By practice of the methods above, a plurality of different recombined nucleic acid sequences encoding a VH chain can be generated, which can represent all possible permutations of recombined segments or subsets thereof. For example, 10, 100, 500, 1000 ($10^3$), $2\times10^3$, $4\times10^3$, $6\times10^3$, $8\times10^3$, $10^4$, $2\times10^4$, $3\times10^4$, $4\times10^4$, $5\times10^4$, $6\times10^4$, $7\times10^4$, $8\times10^4$, $9\times10^4$, $10^5$, $2\times10^5$, $3\times10^5$, $4\times10^5$, $5\times10^5$, $6\times10^5$, $7\times10^5$, $8\times10^5$, $9\times10^5$, $10^6$, $10^7$ or more VH nucleic acid sequences can be generated. By practice of the methods above, a plurality of different recombined nucleic acid sequences encoding a VL chain can be generated, which can represent all possible permutations of recombined segments or subsets thereof. For example, 10, 20, 30, 40, 50, 60, 70, 80, 90, 100, 200, 300, 400, 500, 600, 700, 800, 900, 1000 ($10^3$), $2\times10^3$, $3\times10^3$, $4\times10^3$, $5\times10^3$, $6\times10^3$, $7\times10^3$, $8\times10^3$, $9\times10^3$, $10^4$, $5\times10^4$, $10^5$ or more VL nucleic acid sequences can be generated.

The examples exemplify collection and storage of sequences compiled by practice of the method in a Sequence-History.txt file. Such a file represents sequences generated in the Examples by the exemplified software and ordered for DNA synthesis. Sequences also can be stored manually, for example, in spreadsheets or lists.

ii. Determining Sequence Diversity of Collected Nucleic Acid Sequences

In some examples, recombined nucleic acid molecules can be collected and stored based on their sequence diversity. It is contemplated herein that knowledge of the sequence diversity of library members can be employed to select a restricted subset of nucleic acid sequences encoding VH chain and VL chain for synthesis and expression as described herein below. Hence, resulting antibody libraries can be made to maximize sequence diversity among members due to sequence differences. Alternatively, resulting antibody libraries can be made to minimize sequence diversity among members due to sequence similarities. Thus, for example, the sequence of a selected recombined nucleic acid can be compared to all other sequences in the libraries, and those sequences that are different (e.g. having sequence similarity that is less then 70%, e.g., 10%, 20%, 30%, 40%, 50%, 60%, 65%) can be selected. In another example, if a "Hit" is identified in an initial screen, a further library can be created where all members have a high sequence similarity (e.g. 70%, 75%, 80%, 85%, 90%, 95% or more) to the identified "Hit." The percentages given are for exemplification only. One of skill in the art can choose any desired limit of sequence similarity by which to select sequences for inclusion in a particular library.

To determine the sequence similarity or difference between and among recombined nucleic acid sequences sequence diversity based on sequence similarity of all collected nucleic acid sequences is assessed. Typically, due to the degeneracy of the genetic code, recombined nucleic acid sequences are first translated to give an amino acid sequence, and then sequence similarity between and among the resulting amino acid sequences is determined. Translation is performed based on the genetic code, whereby 64 codons encode the 20 amino acids plus three stop codons (see Table 20). Translation of each sequence can be performed manually or by other computer-based or automated methods. One of skill in the art is familiar with methods of translating proteins. The sequences can be grouped or stored based on their sequence diversity.

Typically, sequence diversity is assessed based on sequence similarity of two or more sequences, such as for example, as determined by alignment. One of skill in the art is familiar with various techniques to determine the sequence similarity (e.g. identity) between and among sequences. For example, sequence similarity can be determined manually by determining nucleotide differences between and among sequences. Sequence similarity or sequence identity of nucleotide or amino acid sequences also can be determined using conventional software or computer programs. Such algorithms are well known to one of skill in the art. For example, to find the best segment of identity or similarity of sequences, BLAST (Altschul et al (1990) J. Mol. Biol. 215:403-410 and Lipman et al (1990) J. Mol. Biol. 215:403-410), FASTA (Lipman et al (1985) Science 227:1435-1441), or Smith and Waterman (Smith and Waterman (1981) J. Mol. Biol. 147: 195-197) homology search programs can be used. To perform global alignments, sequence alignment programs such as the CLUSTAL W (Thompson et al (1994) Nucleic Acids Research 22:4673-4680) can be used.

For example, nucleic acid or amino acid sequences can be assessed for sequence similarity using BLAST. Parameters for sufficient similarity to determine relatedness are computed based on well known methods for calculating statistical similarity. Exemplary parameters for determining relatedness of two or more sequences using the BLAST algorithm, for example, can be as set forth below. Briefly, amino acid sequence alignments can be performed using BLASTP version 2.0.8 (Jan. 5, 1999) and the following parameters: Matrix: 0 BLOSUM62; gap open: 11; gap extension: 1; x_dropoff: 50; expect: 10.0; wordsize: 3; filter: on. Nucleic acid sequence alignments can be performed using BLASTN version 2.0.6 (Sep. 16, 1998) and the following parameters: Match: 1; mismatch:-2; gap open: 5; gap extension: 2; x_dropoff: 50; expect: 10.0; wordsize: I 1; filter: off. Those skilled in the art will know what modifications can be made to the above parameters to either increase or decrease the stringency of the comparison, for example, and determine the relatedness of two or more sequences. The BLAST program provides an output indicator, the BLAST bit score, which is a value calculated from the number of gaps and substitutions associated with each aligned sequence. The higher the score, the more significant the alignment. The bit score can be used to select sequences that have either the most sequence diversity or alternatively, the least sequence diversity to every other selected sequence.

In another example, sequence diversity also can be assessed by comparison of two or more amino acid or nucleic acid sequences by alignment methods, e.g., the CLUSTAL method. (See, e.g., Higgins, D. G. and P. M. Sharp (1988) Gene 73:237-244.) The CLUSTAL algorithm groups sequences into clusters by examining the distances between all pairs. The clusters are aligned pairwise and then in groups. The percentage similarity between two amino acid sequences, e.g., sequence A and sequence B, is calculated by dividing the length of sequence A, minus the number of gap residues in sequence A, minus the number of gap residues in sequence B, into the sum of the residue matches between sequence A and sequence B, times one hundred. Gaps of low or of no similarity between the two amino acid sequences are not included in determining percentage similarity. Sequence similarity (e.g. sequence identity) between nucleic acid sequences can also be counted or calculated by other methods known in the art, e.g., the Jotun Hein method. (See, e.g., Hein, J. (1990) Methods Enzymol. 183:626-645.) Identity between sequences can also be determined by other methods known in the art, e.g., by varying hybridization conditions. BLASTclust is another program that can be used for cluster analysis. BLASTclust is used in the software compilation program described in the Examples.

Diversity and cluster information as well as BLAST bit score information provide the user with several options when selecting sequences. For example, the user can create an antibody library where the selected sequences are as diverse as possible. To do this, the user can use the diversity score and cluster information, and select sequences from different clusters that have the highest diversity. Alternatively, for example, the user can create a an antibody library where one sequence is initially selected and all subsequent sequences are as similar as possible to the first sequence. This can be accomplished by using the BLAST function. The user can BLAST the selected first sequence, and then select all the other sequences for the library using the BLAST bit score, choosing sequences with the highest score and therefore the highest sequence similarity. For example, Example 5 describes implementation of assessing sequence sequence diversity between and among recombined sequences using Software Compilation software. The Example illustrates that BLAST can be performed on all sequences and Blast bit scores calculated to identify the sequence similarity or differences between sequences.

iii. Generating Nucleic Acid Molecules from Recombined Sequences a) Synthesis

Where desired, the sequences can be individually synthesized into nucleic acid molecules. All collected sequences can be synthesized, or a subset of sequences synthesized. Nucleic acid molecules encoding VH or VL chain can be synthesized by methods known to one of skill in the art using synthetic gene synthesis (see e.g., U.S. Pat. Nos. 4,652,639; 5,132,215; 5,093,251; 6,110,668; 6,472,184; published U.S. application Nos. US20060281113; US20070004041; US20070122817; and International PCT Published Application Nos. WO98/15567; WO99/47536; WO00/75364; WO2004035781; WO2005071077). These include standard solid phase polypeptide synthesis methods involving synthesis of single stranded oligos that are ligated together. Methods also include methods using standard triplets that act as universal building blocks that represent all possible sequence combinations, and can be combined in a series of reaction steps (Slonomics®).

Nucleic acids can be synthesized that are 20, 50, 100, 200, 300, 400, 500, 600, 700, 800, 900, 1000 or more base pairs in length. Gene synthesis can be performed by automated methods. Any of the known synthesis methods can be used to produce the nucleic acid molecules. For example, companies exist for the purpose of synthesizing oligonucleotides and genes, for example, Integrated DNA Technologies (IDT) (Coralville, Iowa), TriLink Biotechnologies (San Diego, Calif.), Blue Heron Gene Synthesis (Bothell, Wash.), and Sloning Biotechnology (Puchheim, Germany).

The nucleotide monomers used in the synthesis can be purine and pyrimidine deoxyribonucleotides (adenosine (A), cytidine (C), guanosine (G) and thymidine (T)) or ribonucleotides (A, G, C and U (uridine)), or they can analogs or derivatives of these nucleotides, such as peptide nucleic acid (PNA), phosphorothioate DNA, and other such analogs and derivatives or combinations thereof. Other nucleotide analogs are well known in the art and can be used in synthesizing the oligonucleotides provided herein.

The nucleic acid molecules can be synthesized with nucleotide modifications. In one example, each oligonucleotide contains a terminal phosphate group, for example, a 5' phosphate group. For example, when it is desired to seal nicks between two adjacent oligonucleotides, e.g. following hybridization of the two oligonucleotides to a common opposite strand polynucleotide according to the methods herein, a 5' phosphate group is added to the end of the oligonucleotide whose 5' terminus will be joined with the 3' terminus of another oligonucleotide to seal the nick. In one example, a 5' phosphate (PO4) group is added during oligonucleotide synthesis. In another example, a kinase, such as T4 polynucleotide kinase (T4 PK) is added to the oligonucleotide for addition of the 5' phosphate group. Other oligonucleotide modifications are well-known and can be used with the provided methods.

The synthetic oligonucleotides can be chemically synthesized. Methods for chemical synthesis of oligonucleotides are well-known and involve the addition of nucleotide monomers or trimers to a growing oligonucleotide chain. Typically, synthetic oligonucleotides are made by chemically joining single nucleotide monomers or nucleotide trimers containing protective groups. For example, phosphoramidites, single nucleotides containing protective groups, can be added one at a time. Synthesis typically begins with the 3' end of the oligonucleotide. The 3' most phosphoramidite is attached to a solid support and synthesis proceeds by adding each phosphoramidite to the 5' end of the last. After each addition, the protective group is removed from the 5' phosphate group on the most recently added base, allowing addition of another phosphoramidite. See, for example, Behlke et al. "Chemical Synthesis of Oligonucleotides" Integrated DNA Technologies (2005), 1-12; Allen et al. "Ultramers™—The Longest Oligonucleotides Available with Mass Spectrometry" Integrated DNA Technologies, Technical Report (2007); and McBride and Caruthers *Tetrahedron Lett* 24:245-248, which describe synthesizing oligonucleotides using standard cyanoethyl chemistry (using phosphoramidite monomers and tetrazole catalysis). Such methods typically result in generation of oligonucleotides of 100-200 bases.

Thus, to synthesize larger genes, methods include annealing of a series of smaller oligonucleotides. In such a method, individually designed oligonucleotides are made, such as by using an automated DNA synthesizer, purified and connected by specific annealing using standard ligation or polymerase reactions. Generally, the oligos are designed with overlapping stretches of common sequence to permit annealing. Several methods of gene synthesis have been described, including, but not limited to the ligation of phosphorylated overlapping oligonucleotides (Gupta, N. K. et al. (1968) Studies on polynucleotides, 88. Enzymatic joining of chemically synthesized segments corresponding to the gene for alanine-tRNA. Proc. Natl Acad. Sci. USA, 60, 1338-1344; Fuhrmann M et al., A synthetic gene coding for the green fluorescent protein (GFP) is a versatile reporter in *Chlamydomonas reinhardtii*. Plant J. 1999 August; 19(3):353-61); de novo gene construction using Ultramers (Allen et al. "Ultramers™—The Longest Oligonucleotides Avialable with Mass Spectrometry" Integrated DNA Technologies, Technical Report (2007); the Fok I method (Mandecki, W. and Bolling, T. J. (1988) FokI method of gene synthesis. Gene, 68, 101-107); a modified form of ligase chain reaction for gene synthesis; PCR assembly whereby the full-length molecule is generated progressively by overlap extension (Stemmer, W. P., Crameri, A., Ha, K. D., Brennan, T. M. and Heyneker, H. L. (1995) Single-step assembly of a gene and entire plasmid from large numbers of oligodeoxyribonucleotides. Gene, 164, 49-53), thermodynamically balanced inside-out (Gao X, Yo P, Keith A, Ragan T J, Harris T K. Thermodynamically balanced inside-out (TBIO) PCR-based gene synthesis: a novel method of primer design for high-fidelity assembly of longer gene sequences. Nucleic Acids Res. 2003 Nov. 15; 31(22):e143) or combined approaches (Young L, Dong Q. Two-step total gene synthesis method. Nucleic Acids Res. 2004 Apr. 15; 32(7):e59). Since the error frequency increases with longer oligonucleotides, methods typically include using shorter oligonucleotides (200 base pairs or less) assembled together.

The synthesized molecules can be purified by a number of well-known methods, for example, high-performance liquid chromatography (HPLC), thin layer chromatography (TLC), Polyacrylamide Gel Electrophoresis (PAGE) and desalting.

In one embodiment, the synthesized nucleic acids are arrayed in multiwell plates, with each individual well of a plate corresponding to one individual nucleic acid. More specifically, each individual locus of a plate contains an nucleic acid encoding an antibody variable region, either heavy or light. The identity of the nucleic acid contained within each well of the multiwell plate is known and mapped to an output file that contains the nucleic acid sequences for all of the nucleic acids within the plate. Multiwell plates can include but are not limited to 96-well plates, 384-well plates, and 1536-well plates. In an exemplary embodiment, the nucleic acids are spatially arrayed in a 96-well plate.

Upon synthesis, the resulting nucleic acid molecules are individually addressed into a locus (e.g. a well, chip, tag, and other addressable formats). Each individual locus of a plate can contain a different recombined and synthesized nucleic acid molecule encoding for either a heavy chain variable region or a light chain variable region or portion thereof compared to all other addresses. The identity of the nucleic acid molecule at each locus is known and can be mapped to an output file that contains the sequences for all the nucleic acid molecules within the addressable format. For example, nucleic acid molecules can be addressed by spatial array into multiwell plates, with each individual locus of a plate containing one individual nucleic acid molecule. Multiwell plates can include but are not limited to 12-well plates, 24-well plates, 96-well plates, 384-well plates, and 1536-well plates.

b) Recombinant Generation

In some examples, recombined VH and/or VL sequences, or a subset thereof, can be generated into recombined nucleic acid molecules using recombinant DNA technology. One of skill in the art is familiar with general recombinant DNA techniques, including but not limited to, PCR, cloning and restriction enzyme digestion. Such techniques can be used to combine germline segments as discussed herein above to generate recombined nucleic acid molecules that are in-frame. Generally, each vector is generated individually, such that the identity of the sequence of each vector is known through the cloning process. Thus, the recombinant generation of a combinatorial antibody library is addressable.

In the methods of generating combinatorial antibody libraries using recombinant DNA techniques, germline segments can be linked directly or indirectly by a linker so long as the resulting nucleic acid molecule is in-frame, resulting in a functional and productive antibody. The linker can be a peptide, polypeptide or an amino acid. For example, it is understood that by virtue of using recombinant DNA technologies, including the use of restriction enzymes, that amino acids can be inserted between V-D, D-J and V-J junctions in order to facilitate joining of germline segments. Exemplary of a linker as described herein in Example 14 is a sequence of nucleotides encoding an SY between the 3'end of the $D_H$ germline segment and the 5'end of the $J_H$ germline segment.

In methods of generating a combinatorial antibody library by recombinant DNA techniques, a parent vector or vectors can be generated that contain common nucleic acid sequences between and among members of the library. For example, a vector can be generated that contains nucleic acid sequence for a $V_H$, $D_H$ and/or $J_H$ germline segment, modified forms thereof, or portions thereof and/or a $V_L$ and/or $J_L$ that are common between all members of the library. It is understood that introduction of segments is with reference to the reading frames as described herein above, such that the resulting compiled nucleic acid molecule is in-frame. The description below provides a general summary of a method of generating a combinatorial antibody library using recombinant DNA techniques. It is understood that the reference to the examples is for exemplification only. Using the description provided herein one of skill in the art can generate similar vectors containing nucleic acid compiled from germline segments or modified forms thereof to generate recombined VH or VL chains that are in-frame. For example, it is understood that the order of addition of $V_H/D_H/J_H$ or $V_L/J_L$ segments or portions thereof to the recombinant vectors can occur in any order, so long as the resulting cloned nucleotide sequence encodes a recombined VH or VL chain that is in-frame.

Thus, a parent vector is typically generated containing a sequence common to all members of the library. For example, if all vectors share a common $V_H$ germline sequence, a vector can be generated carrying the $V_H$ germline sequence in its correct reading frame, which can be manipulated for subsequent inclusion of other germline segments. For example, the $V_H$ germline sequence can be modified to include restriction enzyme sites on the 3'end for subsequent joining with a $D_H$ germline sequence. In another example, vectors can be generated containing a portion of a $V_H$, $D_H$ or $J_H$ germline sequence. For example, a vector can be generated containing a common framework consensus sequence as described elsewhere herein. This is exemplified in Example 14 where a modified Plasmid A vector was generated to contain a common framework 4 region of a $J_H$ germline segment. An exemplary parent vector for use in generating a combinatorial antibody library using the methods herein is set forth in SEQ ID NO:2051, which contains a common $V_H$ germline segment (VH3-23 (IGHV3-23*01) that is modified to remove an internal restriction site and add additional restriction sites at the 3'end) and a common framework 4 region of a JH germline segment.

The parent vector can then be used to further introduce remaining germline segments, modified forms thereof, or portions thereof such that a plurality of final vectors are generated each containing a nucleic acid sequence encoding a recombined VH and/or VL chain. The generation from a parent vector to a final vector can occur in steps, thereby resulting in intermediate vectors, generally at least one intermediate vector. Generally, nucleic acid sequences for subsequent germline segments, modified forms thereof or portions thereof are generated as oligonucleotides for subsequent cloning into the parent vector or an intermediate vector. It is understood that if a stop codon is inserted at any step, the stop codon is either removed as described herein above, or the particular segment containing the stop codon is not cloned. To facilitate joining with adjacent nucleic acid sequences, the oligonucleotides are generated to contain complementary restriction enzyme sites at the 3'and/or 5'ends.

For example, depending on the components contained in the parent vector, an intermediate vector can be generated to contain remaining germline segments, modified forms thereof or portions thereof. For example, intermediate vectors can be generated from the parent vector above (set forth in SEQ ID NO:2051), whereby each intermediate vector contains a different $J_H$ segment in its correct reading frame (see e.g. Table 13). The $J_H$ segment can be a germline segment or a modified form thereof. Exemplary of modified $J_H$ segments are any set forth in SEQ ID NOS: 3450-3455 and encoding $J_H$ regions set forth in any of SEQ ID NOS: 3456-3461. The entire $J_H$ segment or a portion of a $J_H$ segment can be added to an existing parent or intermediate vector. For example, if a parent vector is made to contain a consensus framework 4 region as described above, a portion of a $J_H$ segment containing nucleotides corresponding to the last portion of a CDR3 in the $J_H$ segment can be introduced. By virtue of the addition of different segments, for example different $J_H$ segments, in the intermediate vectors, the diversity of the library can be increased. Thus, generally, a plurality of intermediate vectors are generated. For example, Example 14 describes the generation of six intermediate vectors (having a sequence set forth in any of SEQ ID NOS: 2064-2069).

A plurality of final vectors are generated that contain the all components of a compiled germline sequence. As above, the remaining nucleotide to be inserted into the vector are generated as oligonucleotides, and typically contain complementary restriction enzyme sites at the 3'and/or 5'ends. As noted, the oligonucleotides are generated to provide the correct reading frame for the inserted segment and do not contain stop codons. In addition, the oligonucleotides are generated to preserve existing reading frames for the segments contained in the parent or intermediate vectors. For example, as described elsewhere herein, it is understood that the reading frame of the $D_H$ region is not critical. Thus, $D_H$ segments, including $D_H$ germline segments, can be inserted in any reading frame, or can be a random sequence of nucleotides. Example 14 exemplifies generation of a plurality of final vectors by introduction of $D_H$ germline segments (e.g., any set forth in any of SEQ ID NOS: 239-245, 248, 250, 252, 254, 256, 258-272), or inverted segments thereof (e.g., any set forth in any of SEQ ID NOS: 3462-3488), in all three reading frames. In generating the oligonucleotides, however, one or more nucleotides are removed or added from the 3' or 5' ends in order to preserve reading frames of the adjacent $J_H$ segments. This is exemplified in Example 14, which sets forth conditions for removing or adding nucleotides in order to preserve reading frames.

The resulting final vectors contain compiled $V_H/D_H/J_H$ or $V_L/J_L$ germline segments, or modified forms thereof, that encode a recombined VH chain or VL chain. Each final vector is different and contains a different nucleic acid sequence encoding a different recombined VH chain or VL chain. Since the nucleic acid molecules are already cloned into an expression vector, they can be directly transformed into an expression system as discussed in Section f below.

f. Expressing and Producing Antibodies or Portions or Fragments Thereof

In the methods provided herein, recombined nucleic acid molecules, such as synthetic recombined nucleic acid molecules or recombined nucleic acid molecules generated recombinantly, are cloned into an expression vector. The polynucleotides typically are inserted into the vectors using restriction digest and ligation. Any conventional vector known to one of skill in the art can be used for expression in eukaryotic or prokaryotic cells. Exemplary vectors include plasmid A, C and D described herein below. The vector can be used to transform any expression system compatible therewith for amplification of the nucleic acid and/or expression of the encoded variable heavy or variable light chain polypeptide.

Typically, ligation into a vector is in an addressable format such that the identity of the recombined polypeptide expressed therefrom is known. For example, the vectors containing nucleic acids are spatially arrayed in multiwell plates, with each individual locus of a plate containing a vector with one individual nucleic acid inserted. More specifically, each individual locus of a plate contains a vector encoding for either a heavy chain or a light chain. The identity of the nucleic acid contained within each well of the multiwell plate is known, for example, by mapping to stored sequences collected from the compilation or synthesis above. For example, ligation into vectors can be performed directly into multiwall plates already containing synthesized nucleic acid molecules from above. Multiwell plates can include but are not limited to 96-well plates, 384-well plates, and 1536-well plates. In an exemplary embodiment, the nucleic acids are spatially arrayed in a 96-well plate.

Generally in practicing the methods, a nucleic acid molecules encoding a variable heavy chain is ligated into a first vector. A nucleic acid molecule encoding a variable light chain is ligated into a second vector. The first vector and second vector can be co-transformed into the same expression host for co-expression of a variable heavy chain and a variable light chain. The polypeptides, upon expression, will become operably joined by virtue of interactions between the heavy and light chain polypeptides. In some examples, it is possible to operably join the nucleic acid molecules directly prior to expression, such as by including a linker. In such examples, a single nucleic acid molecule encodes a variable heavy chain and a variable light chain, and can be ligated into a single vector for expression thereof.

In all methods herein, the expressed antibodies minimally include a VH chain and a VL chain, or portions thereof sufficient to form an antigen-binding site. In addition, if desired, a constant chain can be included for expression in operative linkage with the variable chains. In all examples of the methods, the recombined nucleic acid molecules, upon expression and ligation, encode for antibodies or fragments thereof, including, but not limited to an IgG, a Fab fragment, a F(ab')2 fragment or a Fv fragment, such as a disulfide-linked Fv or a single chain Fv. An exemplary antibody is a Fab fragment. Such antibodies or fragments thereof can be purified by any methods known to one of skill in the art.

Section F describes methods of expressing and purifying antibodies or fragments thereof.

2. Automation

Any of the steps of the method described above can be automated and/or made high-throughput and/or otherwise rendered more efficient or fast. One of skill in the art is familiar with methods of automation of systems and processes, including the implementation of in silico databases, application of computer programs, robotics and/or other high-throughput methods that can be used in practice of the method. It is contemplated that the entire process of the method can be automated or only a few steps can be automated. The choice of automation is up to the user. The description below and examples exemplify automation of various processes of the method.

a. User-Created Database

Figure 9:
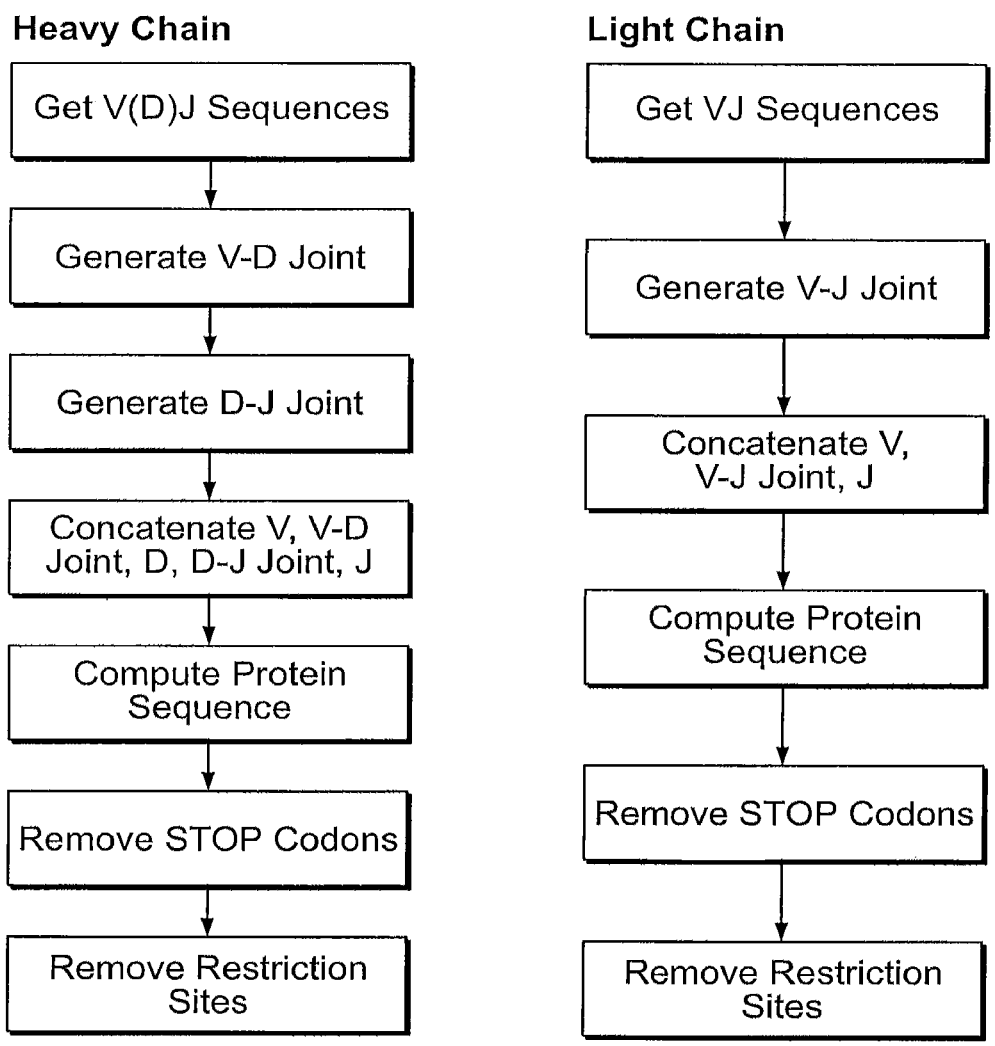
FIG. 9: Algorithm for Sequence Compilation

To practice the methods herein, sequences of germline segments or modified forms thereof must be obtained. Such sequences are known to one of skill in the art and can be obtained from commercially available databases, such as described above. Such germline segment sequences are set forth in the sequence listing as set forth in Tables 3-5 above. Exemplary of modified $J_H$ germline segments are set forth in SEQ ID NOS: 3450-3455. The sequences can be compiled into a user-created database for ease of access. Generation of a file or database containing all of the sequence information provides immediate access to these sequences. In addition the sequence file can be linked to other systems and processes to facilitate performance of the method. For example, as exemplified in FIG. 9, in Example 4, a database file is linked to the Sequence Compilation Alogrithm as an input file for identification of V(D)J heavy and light chain sequences for sequence compilation.

The database file contains sequences for germline $V_H$, $D_H$, $J_H$, $V_K$, $J_K$, $V_\lambda$ and $J_\lambda$ segments. In particular, the database file can contain sequences of nucleic acids set forth in any of SEQ ID NOS:10-451, 868, or a subset thereof. It is helpful if the sequences are specified using FASTA format and all sequences contain a blank line between them. For purposes of practice of the method, the $J_H$, $J_K$ and $J_\lambda$ segment sequences are set forth in the database file in coding frame triplets corresponding to their optimal reading frame, which is set forth in Table 13 above. The sequences in the database file are named for identification. For example, germline segments are identified by section title headings [VH], [DH], [JH], [VK], [JK], [VL], and [JL]. Such a databased file is described in the Examples (e.g. Example 3) as a SequenceDatabase.txt.file. FIG. 11 provides a schematic illustration of a Sequence Database file format.

In addition, the database can contain other sequences used in practicing the method. For example, the database can contain nucleic acid sequences for restriction sites, and can be identified in the database under the section title heading [Restriction Sites]. These sequences can be accessed by particular program processes as described below to identify nucleic acid sequences corresponding to restriction sites within a recombined nucleic acid molecule. Restriction site sequences contained in the database include any of SEQ ID NOS:977-980, 1889-1900. Any restriction site sequence known to one of skill in the art can be contained in the database file. For example, the schematic illustration of a database file in FIG. 11 includes a sequence for the restriction enzyme Mfe I.

It is contemplated that the database file can be periodically updated to contain additional sequences. The database file also can be updated to include any sequence contemplated for practice of the method. For example, nucleic acid sequences that encode for proteins other than antibody germline segments can be entered into the database, using FASTA format, under an appropriate heading. These sequences are then available to be recombined into the germline antibody sequences. For example, one can insert peptide sequences into an antibody at $D_H$ by including nucleic acid sequences encoding for the peptide under the section title [DH].

b. Sequence Compilation

The method of compilation of sequence can be performed in silico, for example, using software. Any software programmed to perform an algorithm or process allowing for compiling germline segments in accordance with the method herein or any suitable method, can be used. One of skill in the art familiar with software programming can generate a computer program capable of performing such an algorithm or process. Generally, the software is programmed to perform any one or more of the following processes:

(a) accessing a user-created in silico database of all available antibody germline segments ($V_H$, $D_H$, $J_H$, $V_\kappa$, $J_\kappa$, $V_\lambda$ and $J_\lambda$);
(b) applying an algorithm to generate every possible recombined full length nucleic acid sequence for heavy chains (5'-$V_H$-$D_H$-$J_H$-3' combinations), every possible recombined full length nucleic acid sequence for kappa light chains (5'-$V_\kappa$-$J_\kappa$-3' combinations) and every possible recombined full length nucleic acid sequence for lambda light chains combinations);
(c) applying an algorithm to modify the nucleic acid sequences of the joints so that the resulting nucleic acids sequences are in frame;
(d) modifying the resulting nucleic acid sequences of the joints to remove any inadvertently generated stop codons;
(e) modifying the resulting full length nucleic acid to optimize codon usage for bacterial expression;
(f) modifying the resulting nucleic acid to remove any undesired restriction sites;
(g) inserting flanking nucleic acids containing restriction sites for cloning at the 5' and 3' termini of the optimized full length nucleic acid sequences;
(h) ranking recombined nucleic acid sequences based on their sequence diversity;
(g) selecting recombined nucleic acid sequence(s) (encoding either a heavy chain variable region or a light chain variable region) from the library of recombined nucleic acid sequences;
(h) assigning the selected nucleic acid sequence to a unique locus of an addressable format;
(i) generating an output file that contains all recombined nucleic acid sequences in the form of the addressed format that lists the distinct heavy chain or light chain sequences such that each locus is addressed and corresponds to a locus of the addressed format (e.g. 96-well plate).

Provided herein are software, computer-readable media, and computer systems for performing the method as described herein. The Examples describe an exemplary software, computer-readable media, computer system and systems. It is understood that those of skill in the art can modify such software, computer-readable media, computer systems and systems based upon this disclosure and that such modifications are included herein.

For example, each of these processes of the method described herein is performed by an exemplary computer software exemplified in the Examples herein. For example, Example 2 and FIGS. 8 and 9 describe an exemplary process for sequence compilation of germline segments. The flow chart in FIG. 9 describes processes for each of steps (a)-(d) and (f) above. In addition, Example 2 and FIG. 10 describes an exemplary process for ranking sequences based on sequence diversity. The flow chart in FIG. 10 describes the process used to rank sequences after determination of diversity scores and an example of the ranking is set forth in FIG. 17.

c. Automation of Protein Expression and Purification

Methods of automating protein expression and purification are known to one of skill in the art (see, e.g., Lesley et al. (2001) Protein Expression and Purification, 22:159-164; Acton T B et al. (2005) Methods Enzymol., 394:210-43; Nguyen et al. (2004) Journal of Structural and Functional Genomics, 5:23-27). Such processes typically include robotic methods.

Exemplary of a high-throughput automated method of protein expression and purification is Piccolo™ (Wollerton et al. (2006) JALA, 11:291-303). The Piccolo™ system automates protein expression and purification of proteins from both *E. coli* and baculovirus mediated insect cell expression systems. Piccolo is able to perform multiple different protein expression and purifications in parallel. The Piccolo system utilizes a 24-position culture vessel block (CVB) in an aeration assembly that supports the expression and purification of multiple samples at once. The Piccolo system contains four modules that perform these functions: a liquid handling module, CVB incubators, a centrifuge and storage carousels. A rail mounted 6-axis RX60L Spinal Transfer Robot (ST Robot; Staubli, Horgen, Switzerland) moves the lab ware between the liquid handling module, incubators, centrifuge and storage carousels. The system is controlled by software that permits the user to control expression and purification conditions.

Expression can be initiated by inoculation of CVB plates containing appropriate growth medium with an an input inoculum, such as a bacterial culture. A total of 576 individual cultures can be grown at any one time, corresponding to 24 culture vessel blocks. The plates can be incubated under user-specified periods and conditions. Typical growth and induction temperatures range from 16° C. to 37° C. Selection of optimal temperatures for growth and induction is well within the level of skill of the skilled artisan. Bacterial growth can be monitored. If desired, protein expression can be induced by adding an appropriate amount of inducer into the CVB plate assembly and further grown under appropriate conditions. Protein expression can be induced by addition of any inducer compatible with the expression vector, including isopropyl -D-1-thiogalactopyranoside (IPTG) and arabinose. Expression times range from 2 hours to 48 hours. Selection of optimal expression times is well within the level of skill of the skilled artisan. Following expression, plates can be stored under cooling conditions. For example, as set forth in Example 9, spatially arrayed transformed cells are mapped to a 24-well culture vessel block for cell growth and protein expression. For each 96-well plate of transformed cells, four culture vessel blocks are generated, thereby allowing the growth of Fabs corresponding to every well of the 96-well plate.

Following expression of the desired protein, the Piccolo™ system also can be used to purify the resulting proteins. The Piccolo machine is programmed to perform lysis and purification steps. The cells are harvested and lysed using an appropriate lysis buffer that is compatible with the purification technique. Selection of a lysis buffer is well within the level of skill of the skilled artisan. The resulting supernatant is then purified by column chromatography with an appropriately modified resin, such as an anti-flag resin or Ni-charged resin. One of skill in the art can identify an appropriate resin for protein purification as described elsewhere herein. The resin should be manually equilibrated in an appropriate wash buffer before starting the run. The bound protein can be eluted with an appropriate elution buffer and the eluate collected in an output plate. The output plate can be stored at cool temperatures (e.g. 6° C.) until collected by the operator.

Purity can be assessed by any method known in the art including gel electrophoresis and staining and spectrophotometric techniques. Additional purification methods can be combined with Piccolo such as are described elsewhere herein. For example, proteins can be further purified using an orthogonal secondary high throughput method of protein purification (see e.g. Example 10). Additional column chromatography can be performed using a compatible resin, an Aktapurifier (GE Healthcare) and an autosampler. Exemplary of purifying antibodies, a protein G resin can be utilized.

E. Libraries

Provided herein are libraries. The libraries include nucleic acid libraries encoding VH or VL chains, vector libraries transformed with recombined nucleic acid molecules, and antibody libraries. In some examples, the members of each of the libraries are addressed in an addressable format, such as any discussed in Section E.2. The members of the libraries and the resulting libraries can be produced by the methods described herein above.

1. VH Nucleic Acid Libraries and Vector Libraries thereof

Provided herein are recombined nucleic acid libraries encoding VH chains. The libraries provided herein include recombined nucleic acid molecules made up entirely of $V_H$, $D_H$ and $J_H$ germline segments or modified forms thereof. The $V_H$, $D_H$ and $J_H$ germline segments include any set forth in Table 3 above, modified forms thereof, or a subset thereof. Any permutation is possible. The resulting nucleic acid molecule in the library have a sequence such that the $V_H$ segment is 5' to the $D_H$ segment which is 5' to the $J_H$ segment. The segments can be linked directly or indirectly by a peptide linker.

Because the nucleic acid molecules in the library are derived from germline segments, members of such a nucleic acid library are capable of encoding a naïve antibody when co-expressed with a nucleic acid encoding a VL chain. It is understood that the library is considered to be naïve and derived from germline even though, in practicing the method herein, the joint regions of the segments are altered to render the resulting encoding nucleic acid molecules in frame. Such alterations, however, are minor and variously include insertion or deletion generally of only a single nucleotide of a germline segment. In addition, other modification made to the recombined nucleic acid sequence by virtue of practice of the method herein, such as removal of stop codons and restriction enzyme site sequences, also result in naïve antibodies.

It is understood that libraries can be generated that are compiled from sequences that include modified germline segments. In some examples of the libraries, the libraries include recombined nucleic acid molecules made up entirely of a $V_H$ and a $J_H$ germline segment, and also any sequence of nucleotides between the $V_H$ and $J_H$ germline segment. This is the region that includes the central portion of the CDRH3, which is largely responsible for the antigen specificity of the resulting antibody. The sequence of nucleotides can be any random sequence of nucleotides. In some instances, the sequence of nucleotides is a sequence that encodes a peptide mimetic against any desired target, for example, a cell surface receptor. Exemplary peptide mimetics are set forth in Table 16. Generally, the sequence of nucleotides is or is about 5, 10, 15, 20, 25, 30, 40, 50, 60, 70, 80, 90 or more nucleotides in length. The resulting nucleic acid molecule in the library have a sequence such that the $V_H$ segment is 5' to the random sequence of nucleotides which is 5' to the $J_H$ segment. In some examples, the random sequence of nucleotides is a $D_H$ germline segment.

In other examples, the libraries provided herein include recombined nucleic acid molecules where at least one, two or all three of a $V_H$, $D_H$ and $J_H$ germline segment contained therein are modified, for example, due to modification by insertion, deletion or addition of amino acids. For example, the libraries include nucleic acid molecules containing sequences encoding a directed peptide. The libraries also include recombined nucleic acid molecules containing nucleotide mutations encoding amino acid replacements, for example, of one or more amino acids of a CDR. In an additional example, the libraries provided herein include recombined nucleic acid molecules where at least a portion of the nucleic acid molecule, such as the entire nucleic acid molecule encoding the VH chain, or at least one or more of a $V_H$, $D_H$ and $J_H$ are derived from an existing monoclonal antibody, including, but not limited to, any monoclonal antibody set forth in Table 9. For example, exemplary libraries provided herein can include a nucleic acid molecule encoding the VH chain of an anti-CD20 antibody such as is set forth in SEQ ID NO:1043 or SEQ ID NO:1058 (SEQ ID NO:453 including terminal restriction site sequences) or Herceptin such as is set forth in SEQ ID NO:1057 (SEQ ID NO:452 including terminal restriction site sequences)

Libraries of recombined nucleic acid molecules provided herein can include members that represent one, some or all of the above examples. Any of the libraries provided herein also can include members whose sequences include heterologous sequence, for example, restriction site sequences, linker sequences, sequences encoding tags or other detectable moieties or other sequences.

In the VH nucleic acid libraries provided herein, each recombined nucleic acid molecule member of the library is productive and, when co-expressed with a nucleic acid molecule encoding a VH chain, generates a functional antibody or portion thereof that is sufficient to form an antigen-binding site. In addition, in the VH nucleic acid libraries provided herein, each nucleic acid member of the library is different. The VH nucleic acid libraries provided herein can contain 10, 20, 30, 40, 50, 60, 70, 80, 90, 100, 200, 300, 400, 500, 600, 700, 800, 900, 1000, 2000, 3000, 4000, 5000, 6000, 7000, 8000, 9000, 10,000 ($10^4$), $2 \times 10^4$, $3 \times 10^4$, $4 \times 10^4$, $5 \times 10^4$, $6 \times 10^4$, $7 \times 10^4$, $8 \times 10^4$, $9 \times 10^4$, $10^5$, $2 \times 10^5$, $3 \times 10^5$, $4 \times 10^5$, $5 \times 10^5$, $6 \times 10^5$, $7 \times 10^5$, $8 \times 10^5$, $9 \times 10^5$, $10^6$ or more different members. The nucleic acid members are provided in addressed formats, such that when addressed the identity of each nucleic acid is known by its location in the array.

For example, an exemplary VH nucleic acid library includes members set forth in SEQ ID NOS: 454-805, each representing a different recombined nucleic acid molecule of $V_H$, $D_H$ and $J_H$ germline segments. Such a library includes members containing heterologous sequence for restriction sites at the 3' and 5' ends. It is understood that members of the library also can include those having sequences not including the heterologous sequence, such as is set forth in any of SEQ ID NOS: 1059-1410.

In an additional example, an exemplary VH nucleic acid library includes members set forth in SEQ ID NOS: 2070-2759, each representing a different recombined nucleic acid molecule of $V_H$, $D_H$ and $J_H$ germline segments or modified forms thereof. Such a library includes members containing heterologous sequence for restriction sites at the 3'end corresponding to CTAGC (set forth in SEQ ID NO:1903) and at the 5'end corresponding to CCATGGCA (set forth in SEQ ID NO:1901). It is understood that members of the library also can include those having sequences set forth in any of SEQ ID NOS: 2070-2759 that do no include the heterologous sequences at one or both of the 3'and 5'ends.

A VH nucleic acid library can include members from any of the libraries provided herein, or a subset thereof. For example, a VH nucleic acid library includes members set forth in any of SEQ ID NOS:454-805 and 2070-2759, or a subset thereof. The library members can include those containing heterologous sequences at the 3' or 5'ends, and/or members that do not include heterologous sequences.

In some examples, any of the nucleic acid sequences in the libraries provided herein can be included in a vector to generate vector libraries. Exemplary of vector libraries are libraries of recombined nucleic acid molecules encoding VH chain included in backbone Plasmid A or Plasmid D.

2. VL Nucleic Acid Libraries and Vector Libraries Thereof

Provided herein are recombined nucleic acid libraries encoding VL chains. The libraries include those encoding for lambda or gamma light chains, or combinations thereof. Thus, the libraries provided herein include recombined nucleic acid molecules made up entirely of $V_\kappa$ and $J_\kappa$ germline segments and/or $V_\lambda$ and $J_\lambda$ germline segments. The $V_\kappa$ and $J_\kappa$ germline segments and/or $V_\lambda$ and $J_\lambda$ germline segments include any set forth in Tables 4-5 above, or a subset thereof. Any permutation is possible. The resulting nucleic acid molecules in the library have a sequence such that the $V_L$ segment ($V_\kappa$ or $V_\lambda$) is 5' to the $J_L$ segment ($J_\kappa$ or $J_\lambda$).

Because the nucleic acid molecules in the library are derived from germline segments, members of such a nucleic acid library are capable of encoding a naïve antibody when co-expressed with a nucleic acid encoding a VH chain. It is understood that the library is considered to be naïve and derived from germline even though, in practicing the method herein, the joint regions of the segments are altered to render the resulting encoding nucleic acid molecules in frame. Such alterations, however, are minor and variously include insertion or deletion generally of only a single nucleotide of a germline segment. In addition, other modification made to the recombined nucleic acid sequence by virtue of practice of the method herein, such as removal of stop codons and restriction enzyme site sequences, also result in naïve antibodies.

In some examples, the libraries provided herein include recombined nucleic acid molecules where at least one or both a $V_\kappa$, and $J_\kappa$ germline segment or a $V_\lambda$ and $J_\lambda$ germline segment contained therein are modified, for example, due to modification by insertion, deletion or addition of amino acids. For example, the libraries include nucleic acid molecules containing sequences encoding a directed peptide. The libraries also include recombined nucleic acid molecules containing nucleotide mutations encoding amino acid replacements, for example, of one or more amino acids of a CDR. In an additional example, the libraries provided herein include recombined nucleic acid molecules where at least a portion of the nucleic acid molecule, such as the entire nucleic acid molecule encoding the VH chain, or at least one or more of a $V_\kappa$, and $J_\kappa$ or $V_\lambda$ and $J_\lambda$ are derived from an existing monoclonal antibody including, but not limited to, any monoclonal antibody set forth in Table 9. For example, exemplary libraries provided herein can include a nucleic acid molecule encoding the VL chain of Herceptin such as is set forth in SEQ ID NO: 1423 (SEQ ID NO:818 including terminal restriction site sequences) or the VL chain of an anti-CD20 antibody such as is set forth in SEQ ID NO: 1050 or SEQ ID NO:1440 (SEQ ID NO:835 including terminal restriction site sequences).

Libraries of recombined nucleic acid molecules provided herein can include members that represent one, some or all of the above examples. Any of the libraries provided herein also can include members whose sequences include heterologous sequence, for example, restriction site sequences, linker sequences, sequences encoding tags or other detectable moieties or other sequences.

In the VL nucleic acid libraries provided herein, each recombined nucleic acid molecule member of the library is productive and, when co-expressed with a nucleic acid molecule encoding a VH chain, generates a functional antibody or portion thereof that contains a sufficient antigen-binding site. In addition, in the VL nucleic acid libraries provided herein, each nucleic acid member of the library is different. The VL nucleic acid libraries provided herein can contain 10, 20, 30, 40, 50, 60, 70, 80, 90, 100, 200, 300, 400, 500, 600, 700, 800, 900, 1000, 2000, 3000, 4000, 5000, 6000, 7000, 8000, 9000, 10,000 ($10^4$), $2\times10^4$, $3\times10^4$, $4\times10^4$, $5\times10^4$, $6\times10^4$, $7\times10^4$, $8\times10^4$, $9\times10^4$, $10^5$, $2\times10^5$, $3\times10^5$, $4\times10^5$, $5\times10^5$, $6\times10^5$, $7\times10^5$, $8\times10^5$, $9\times10^5$, $10^6$ or more different members. The nucleic acid members are provided in addressed formats, such that when addressed the identity of each nucleic acid is known by its location in the array.

For example, an exemplary VL nucleic acid library includes members set forth in SEQ ID NOS: 806-815, 817, 819-834, 836-867 each representing a different recombined nucleic acid molecule of $V_\kappa$, and $J_\kappa$ germline segments. Such a library includes members containing heterologous sequence for restriction sites at the 3' and 5' ends. It is understood that members of the library also can include those having sequences not including the heterologous sequence, such as is set forth in any of SEQ ID NOS: 1411-1422, 1424-1439, 1441-1472.

In some examples, any of the nucleic acid sequences in the libraries provided herein can be included in a vector to generate vector libraries. Exemplary of vector libraries are libraries of recombined nucleic acid molecules encoding VL chain included in backbone Plasmid C or Plasmid E.

3. Paired Nucleic Acid Libraries or Vector Libraries Thereof

Also provided herein are libraries containing both recombined nucleic acid molecules encoding a VH chain and nucleic acid molecules encoding a VL chain, i.e. paired nucleic acid libraries. The paired libraries provided herein can contain a first nucleic acid molecule that is any of the nucleic acid members of the VH nucleic acid library in Section E.1 above and a second nucleic acid molecule that is any of the nucleic acid members of the VL nucleic acid library in Section E.2 above. The nucleic acid members in the paired libraries include those having heterologous sequence and those not having heterologous sequence. In some examples, one of the nucleic acid molecules in the pair can contain a heterologous sequence (e.g. a tag or other detectable moiety), while the other paired molecule at the locus in the library does not contain any heterologous sequence.

The paired nucleic acid libraries can be provided as addressed libraries. In such libraries, each locus of an addressed format contains one nucleic acid molecule encoding a VH chain and one nucleic acid molecule encoding a VL chain. Each nucleic acid pair (i.e. the combination of the nucleic acid molecule encoding the VH chain and the nucleic acid molecule encoding the VL chain) is different compared to all other pairs at all other addressed loci.

In some examples, the nucleic acid molecules can be contained in vectors to generate paired vector libraries. In such libraries, each locus of the addressed library includes a vector containing a nucleic acid molecule encoding a VL chain and a vector containing a nucleic acid molecule encoding a VH chain.

In some examples, the paired nucleic acid libraries can contain a common nucleic acid molecule encoding a VL chain such that each locus in the library contains the same nucleic acid molecule. In other examples, the paired nucleic acid libraries can contain a common nucleic acid molecule encoding a VH chain such that each locus in the library contains the same nucleic acid molecule. Generally, a library contains 1, 2, 3, 4, 5, 6, 7, 8, 9, 10, 11, 12, 13, 14, 15, 16, 17, 18, 19, 20, 100, 200, 300, 400, 500, 600, 700, 800, 900, 1000, 5,000, 10,000 or more nucleic acid molecules encoding a VL chain and 1, 2, 3, 4, 5, 6, 7, 8, 9, 10, 11, 12, 13, 14, 15, 16, 17, 18, 19, 20, 100, 200, 300, 400, 500, 600, 700, 800, 900, 1000, 5,000, 10,000 or more nucleic acid molecules encoding a VH chain. The resulting paired library contains 10, 20, 30, 40, 50, 60, 70, 80, 90, 100, 200, 300, 400, 500, 600, 700, 800, 900, 1000, 2000, 3000, 4000, 5000, 6000, 7000, 8000, 9000, 10,000 ($10^4$), $2 \times 10^4$, $3 \times 10^4$, $4 \times 10^4$, $5 \times 10^4$, $6 \times 10^4$, $7 \times 10^4$, $8 \times 10^4$, $9 \times 10^4$, $10^5$, $2 \times 10^5$, $3 \times 10^5$, $4 \times 10^5$, $5 \times 10^5$, $6 \times 10^5$, $7 \times 10^5$, $8 \times 10^5$, $9 \times 10^5$, $10^6$, $10^7$, $10^8$, $10^9$, $10^{10}$ or more different paired members.

As described herein below, upon co-expression of a first and second nucleic acid molecule (e.g a nucleic acid molecule encoding a VH chain and a nucleic acid encoding a light chain), a library of antibodies can be generated. If the nucleic acid molecule further contains a sequence encoding a CH, a Fab library can be generated, whereby each member in the library contains a VH chain and a VL chain linked by a CH.

For example, an exemplary nucleic acid paired library includes those where a first nucleic acid is any one or more nucleic acids molecules set forth in any of SEQ ID NOS: 454-805 or 2070-2759 (each encoding a VH chain), and a second nucleic acid molecule set forth in any of SEQ ID NOS: 806-815, 817, 819-834, and 836-867 (each encoding a VL chain). The sequences set forth above contain heterologous sequence for restriction sites at the 3' and 5' ends. It is understood that nucleic acid libraries can be generated without the heterologus sequences. Thus, in some examples, members of the library also can include those having sequences not including a heterologous sequence. For example, an exemplary nucleic acid paired library includes nucleic acid sequences not containing heterologous sequence for restriction sites at the 3' and 5' ends from a first nucleic acid set forth in any of SEQ ID NOS: 1059-1410 or 2070-2759 (not including the 3'and 5'restriction sites) (each encoding a VH chain) and a second nucleic acid molecule set forth in SEQ ID NOS: 1411-1422, 1424-1439 and 1441-1471. Such a library can include all permutations of any of the above paired nucleic acid sequences. Thus, the paired library can contain at or about $1.5 \times 10^5$, $2.1 \times 10^5$, $2.5 \times 10^5$, $3.5 \times 10^5$, $4 \times 10^5$, $4.2 \times 10^5$, $4.4 \times 10^5$, $4.6 \times 10^5$, $4.8 \times 10^5$, $5 \times 10^5$, $5.2 \times 10^5$, $5.4 \times 10^5$, $5.6 \times 10^5$, $5.8 \times 10^5$, $6 \times 10'$, or more members, or a subset thereof such as 500, 600, 700, 800, 900, $10^3$, $5 \times 10^3$, $10^4$, $5 \times 10^4$, $10^5$ or more members.

Exemplary of a paired library is set forth in Table 17, where each row sets forth a different loci of the library. In the Table, SEQ ID NOS for the nucleic acid molecules are set forth as "RS" (containing a heterologous restriction site sequence) and "NO RS" (not containing a heterologous restriction site sequence).

TABLE 17

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 1 | gnl\|Fabrus\|VH3-23_IGHD1-1*01_IGHJ4*01 | 595 | 1200 | gnl\|Fabrus\|O12_IGKJ1*01 | 833 | 1438 |
| 2 | gnl\|Fabrus\|VH3-23_IGHD2-15*01_IGHJ4*01 | 598 | 1203 | gnl\|Fabrus\|O12_IGKJ1*01 | 833 | 1438 |
| 3 | gnl\|Fabrus\|VH3-23_IGHD3-22*01_IGHJ4*01 | 602 | 1207 | gnl\|Fabrus\|O12_IGKJ1*01 | 833 | 1438 |
| 4 | gnl\|Fabrus\|VH3-23_IGHD4-11*01_IGHJ4*01 | 604 | 1209 | gnl\|Fabrus\|O12_IGKJ1*01 | 833 | 1438 |
| 5 | gnl\|Fabrus\|VH3-23_IGHD5-12*01_IGHJ4*01 | 606 | 1211 | gnl\|Fabrus\|O12_IGKJ1*01 | 833 | 1438 |
| 6 | gnl\|Fabrus\|VH3-23_IGHD5-5*01_IGHJ4*01 | 608 | 1213 | gnl\|Fabrus\|O12_IGKJ1*01 | 833 | 1438 |
| 7 | gnl\|Fabrus\|VH3-23_IGHD6-13*01_IGHJ4*01 | 609 | 1214 | gnl\|Fabrus\|O12_IGKJ1*01 | 833 | 1438 |
| 8 | gnl\|Fabrus\|VH3-23_IGHD7-27*01_IGHJ4*01 | 612 | 1217 | gnl\|Fabrus\|O12_IGKJ1*01 | 833 | 1438 |
| 9 | gnl\|Fabrus\|VH3-23_IGHD7-27*01_IGHJ6*01 | 613 | 1218 | gnl\|Fabrus\|O12_IGKJ1*01 | 833 | 1438 |
| 10 | gnl\|Fabrus\|VH1-69_IGHD1-14*01_IGHJ4*01 | 502 | 1107 | gnl\|Fabrus\|O12_IGKJ1*01 | 833 | 1438 |
| 11 | gnl\|Fabrus\|VH1-69_IGHD2-2*01_IGHJ4*01 | 503 | 1108 | gnl\|Fabrus\|O12_IGKJ1*01 | 833 | 1438 |
| 12 | gnl\|Fabrus\|VH1-69_IGHD2-8*01_IGHJ6*01 | 504 | 1109 | gnl\|Fabrus\|O12_IGKJ1*01 | 833 | 1438 |
| 13 | gnl\|Fabrus\|VH1-69_IGHD3-16*01_IGHJ4*01 | 505 | 1110 | gnl\|Fabrus\|O12_IGKJ1*01 | 833 | 1438 |
| 14 | gnl\|Fabrus\|VH1-69_IGHD3-3*01_IGHJ4*01 | 506 | 1111 | gnl\|Fabrus\|O12_IGKJ1*01 | 833 | 1438 |
| 15 | gnl\|Fabrus\|VH1-69_IGHD4-17*01_IGHJ4*01 | 508 | 1113 | gnl\|Fabrus\|O12_IGKJ1*01 | 833 | 1438 |
| 16 | gnl\|Fabrus\|VH1-69_IGHD5-12*01_IGHJ4*01 | 509 | 1114 | gnl\|Fabrus\|O12_IGKJ1*01 | 833 | 1438 |
| 17 | gnl\|Fabrus\|VH1-69_IGHD6-19*01_IGHJ4*01 | 511 | 1116 | gnl\|Fabrus\|O12_IGKJ1*01 | 833 | 1438 |
| 18 | gnl\|Fabrus\|VH1-69_IGHD7-27*01_IGHJ4*01 | 513 | 1118 | gnl\|Fabrus\|O12_IGKJ1*01 | 833 | 1438 |
| 19 | gnl\|Fabrus\|VH4-34_IGHD1-7*01_IGHJ4*01 | 749 | 1354 | gnl\|Fabrus\|O12_IGKJ1*01 | 833 | 1438 |
| 20 | gnl\|Fabrus\|VH4-34_IGHD2-2*01_IGHJ4*01 | 750 | 1355 | gnl\|Fabrus\|O12_IGKJ1*01 | 833 | 1438 |
| 21 | gnl\|Fabrus\|VH4-34_IGHD3-16*01_IGHJ4*01 | 751 | 1356 | gnl\|Fabrus\|O12_IGKJ1*01 | 833 | 1438 |
| 22 | gnl\|Fabrus\|VH4-34_IGHD4-17*01_IGHJ4*01 | 753 | 1358 | gnl\|Fabrus\|O12_IGKJ1*01 | 833 | 1438 |
| 23 | gnl\|Fabrus\|VH4-34_IGHD5-12*01_IGHJ4*01 | 754 | 1359 | gnl\|Fabrus\|O12_IGKJ1*01 | 833 | 1438 |
| 24 | gnl\|Fabrus\|VH4-34_IGHD6-13*01_IGHJ4*01 | 755 | 1360 | gnl\|Fabrus\|O12_IGKJ1*01 | 833 | 1438 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 25 | gnl\|Fabrus\|VH4-34__IGHD6-25*01__IGHJ6*01 | 756 | 1361 | gnl\|Fabrus\|O12__IGKJ1*01 | 833 | 1438 |
| 26 | gnl\|Fabrus\|VH4-34__IGHD7-27*01__IGHJ4*01 | 758 | 1363 | gnl\|Fabrus\|O12__IGKJ1*01 | 833 | 1438 |
| 27 | gnl\|Fabrus\|VH2-26__IGHD1-20*01__IGHJ4*01 | 521 | 1126 | gnl\|Fabrus\|O12__IGKJ1*01 | 833 | 1438 |
| 28 | gnl\|Fabrus\|VH2-26__IGHD2-2*01__IGHJ4*01 | 523 | 1128 | gnl\|Fabrus\|O12__IGKJ1*01 | 833 | 1438 |
| 29 | gnl\|Fabrus\|VH2-26__IGHD3-10*01__IGHJ4*01 | 524 | 1129 | gnl\|Fabrus\|O12__IGKJ1*01 | 833 | 1438 |
| 30 | gnl\|Fabrus\|VH2-26__IGHD4-11*01__IGHJ4*01 | 526 | 1131 | gnl\|Fabrus\|O12__IGKJ1*01 | 833 | 1438 |
| 31 | gnl\|Fabrus\|VH2-26__IGHD5-18*01__IGHJ4*01 | 528 | 1133 | gnl\|Fabrus\|O12__IGKJ1*01 | 833 | 1438 |
| 32 | gnl\|Fabrus\|VH2-26__IGHD6-13*01__IGHJ4*01 | 529 | 1134 | gnl\|Fabrus\|O12__IGKJ1*01 | 833 | 1438 |
| 33 | gnl\|Fabrus\|VH2-26__IGHD7-27*01__IGHJ4*01 | 530 | 1135 | gnl\|Fabrus\|O12__IGKJ1*01 | 833 | 1438 |
| 34 | gnl\|Fabrus\|VH5-51__IGHD1-14*01__IGHJ4*01 | 776 | 1381 | gnl\|Fabrus\|O12__IGKJ1*01 | 833 | 1438 |
| 35 | gnl\|Fabrus\|VH5-51__IGHD2-8*01__IGHJ4*01 | 778 | 1383 | gnl\|Fabrus\|O12__IGKJ1*01 | 833 | 1438 |
| 36 | gnl\|Fabrus\|VH5-51__IGHD3-3*01__IGHJ4*01 | 780 | 1385 | gnl\|Fabrus\|O12__IGKJ1*01 | 833 | 1438 |
| 37 | gnl\|Fabrus\|VH5-51__IGHD4-17*01__IGHJ4*01 | 781 | 1386 | gnl\|Fabrus\|O12__IGKJ1*01 | 833 | 1438 |
| 38 | gnl\|Fabrus\|VH5-51__IGHD5-18*01>3__IGHJ4*01 | 782 | 1387 | gnl\|Fabrus\|O12__IGKJ1*01 | 833 | 1438 |
| 39 | gnl\|Fabrus\|VH5-51__IGHD5-18*01>1__IGHJ4*01 | 783 | 1388 | gnl\|Fabrus\|O12__IGKJ1*01 | 833 | 1438 |
| 40 | gnl\|Fabrus\|VH5-51__IGHD6-25*01__IGHJ4*01 | 784 | 1389 | gnl\|Fabrus\|O12__IGKJ1*01 | 833 | 1438 |
| 41 | gnl\|Fabrus\|VH5-51__IGHD7-27*01__IGHJ4*01 | 785 | 1390 | gnl\|Fabrus\|O12__IGKJ1*01 | 833 | 1438 |
| 42 | gnl\|Fabrus\|VH6-1__IGHD1-1*01__IGHJ4*01 | 786 | 1391 | gnl\|Fabrus\|O12__IGKJ1*01 | 833 | 1438 |
| 43 | gnl\|Fabrus\|VH6-1__IGHD2-15*01__IGHJ4*01 | 788 | 1393 | gnl\|Fabrus\|O12__IGKJ1*01 | 833 | 1438 |
| 44 | gnl\|Fabrus\|VH6-1__IGHD3-3*01__IGHJ4*01 | 791 | 1396 | gnl\|Fabrus\|O12__IGKJ1*01 | 833 | 1438 |
| 45 | gnl\|Fabrus\|VH6-1__IGHD4-23*01__IGHJ4*01 | 793 | 1398 | gnl\|Fabrus\|O12__IGKJ1*01 | 833 | 1438 |
| 46 | gnl\|Fabrus\|VH6-1__IGHD4-11*01__IGHJ6*01 | 792 | 1397 | gnl\|Fabrus\|O12__IGKJ1*01 | 833 | 1438 |
| 47 | gnl\|Fabrus\|VH6-1__IGHD5-5*01__IGHJ4*01 | 794 | 1399 | gnl\|Fabrus\|O12__IGKJ1*01 | 833 | 1438 |
| 48 | gnl\|Fabrus\|VH6-1__IGHD6-13*01__IGHJ4*01 | 795 | 1400 | gnl\|Fabrus\|O12__IGKJ1*01 | 833 | 1438 |
| 49 | gnl\|Fabrus\|VH6-1__IGHD6-25*01__IGHJ6*01 | 796 | 1401 | gnl\|Fabrus\|O12__IGKJ1*01 | 833 | 1438 |
| 50 | gnl\|Fabrus\|VH6-1__IGHD7-27*01__IGHJ4*01 | 797 | 1402 | gnl\|Fabrus\|O12__IGKJ1*01 | 833 | 1438 |
| 51 | gnl\|Fabrus\|VH4-59__IGHD6-25*01__IGHJ3*01 | 775 | 1380 | gnl\|Fabrus\|O12__IGKJ1*01 | 833 | 1438 |
| 52 | gnl\|Fabrus\|VH3-48__IGHD6-6*01__IGHJ1*01 | 655 | 1260 | gnl\|Fabrus\|O12__IGKJ1*01 | 833 | 1438 |
| 53 | gnl\|Fabrus\|VH3-30__IGHD6-6*01__IGHJ1*01 | 625 | 1230 | gnl\|Fabrus\|O12__IGKJ1*01 | 833 | 1438 |
| 54 | gnl\|Fabrus\|VH3-66__IGHD6-6*01__IGHJ1*01 | 681 | 1286 | gnl\|Fabrus\|O12__IGKJ1*01 | 833 | 1438 |
| 55 | gnl\|Fabrus\|VH3-53__IGHD5-5*01__IGHJ4*01 | 670 | 1275 | gnl\|Fabrus\|O12__IGKJ1*01 | 833 | 1438 |
| 56 | gnl\|Fabrus\|VH2-5__IGHD5-12*01__IGHJ4*01 | 536 | 1141 | gnl\|Fabrus\|O12__IGKJ1*01 | 833 | 1438 |
| 57 | gnl\|Fabrus\|VH2-70__IGHD5-12*01__IGHJ4*01 | 543 | 1148 | gnl\|Fabrus\|O12__IGKJ1*01 | 833 | 1438 |
| 58 | gnl\|Fabrus\|VH3-15__IGHD5-12*01__IGHJ4*01 | 567 | 1172 | gnl\|Fabrus\|O12__IGKJ1*01 | 833 | 1438 |
| 59 | gnl\|Fabrus\|VH3-15__IGHD3-10*01__IGHJ4*01 | 565 | 1170 | gnl\|Fabrus\|O12__IGKJ1*01 | 833 | 1438 |
| 60 | gnl\|Fabrus\|VH3-49__IGHD5-18*01__IGHJ4*01 | 662 | 1267 | gnl\|Fabrus\|O12__IGKJ1*01 | 833 | 1438 |
| 61 | gnl\|Fabrus\|VH3-49__IGHD6-13*01__IGHJ4*01 | 663 | 1268 | gnl\|Fabrus\|O12__IGKJ1*01 | 833 | 1438 |
| 62 | gnl\|Fabrus\|VH3-72__IGHD5-18*01__IGHJ4*01 | 699 | 1304 | gnl\|Fabrus\|O12__IGKJ1*01 | 833 | 1438 |
| 63 | gnl\|Fabrus\|VH3-72__IGHD6-6*01__IGHJ1*01 | 701 | 1306 | gnl\|Fabrus\|O12__IGKJ1*01 | 833 | 1438 |
| 64 | gnl\|Fabrus\|VH3-73__IGHD5-12*01__IGHJ4*01 | 709 | 1314 | gnl\|Fabrus\|O12__IGKJ1*01 | 833 | 1438 |
| 65 | gnl\|Fabrus\|VH3-73__IGHD4-23*01__IGHJ5*01 | 708 | 1313 | gnl\|Fabrus\|O12__IGKJ1*01 | 833 | 1438 |
| 66 | gnl\|Fabrus\|VH3-43__IGHD3-22*01__IGHJ4*01 | 650 | 1255 | gnl\|Fabrus\|O12__IGKJ1*01 | 833 | 1438 |
| 67 | gnl\|Fabrus\|VH3-43__IGHD6-13*01__IGHJ4*01 | 653 | 1258 | gnl\|Fabrus\|O12__IGKJ1*01 | 833 | 1438 |
| 68 | gnl\|Fabrus\|VH3-9__IGHD3-22*01__IGHJ4*01 | 724 | 1329 | gnl\|Fabrus\|O12__IGKJ1*01 | 833 | 1438 |
| 69 | gnl\|Fabrus\|VH3-9__IGHD1-7*01__IGHJ5*01 | 721 | 1326 | gnl\|Fabrus\|O12__IGKJ1*01 | 833 | 1438 |
| 70 | gnl\|Fabrus\|VH3-9__IGHD6-13*01__IGHJ4*01 | 727 | 1332 | gnl\|Fabrus\|O12__IGKJ1*01 | 833 | 1438 |
| 71 | gnl\|Fabrus\|VH4-39__IGHD3-10*01__IGHJ4*01 | 762 | 1367 | gnl\|Fabrus\|O12__IGKJ1*01 | 833 | 1438 |
| 72 | gnl\|Fabrus\|VH4-39__IGHD5-12*01__IGHJ4*01 | 766 | 1371 | gnl\|Fabrus\|O12__IGKJ1*01 | 833 | 1438 |
| 73 | gnl\|Fabrus\|VH1-18__IGHD6-6*01__IGHJ1*01 | 460 | 1065 | gnl\|Fabrus\|O12__IGKJ1*01 | 833 | 1438 |
| 74 | gnl\|Fabrus\|VH1-24__IGHD5-12*01__IGHJ4*01 | 467 | 1072 | gnl\|Fabrus\|O12__IGKJ1*01 | 833 | 1438 |
| 75 | gnl\|Fabrus\|VH1-2__IGHD1-1*01__IGHJ3*01 | 461 | 1066 | gnl\|Fabrus\|O12__IGKJ1*01 | 833 | 1438 |
| 76 | gnl\|Fabrus\|VH1-3__IGHD6-6*01__IGHJ1*01 | 475 | 1080 | gnl\|Fabrus\|O12__IGKJ1*01 | 833 | 1438 |
| 77 | gnl\|Fabrus\|VH1-45__IGHD3-10*01__IGHJ4*01 | 480 | 1085 | gnl\|Fabrus\|O12__IGKJ1*01 | 833 | 1438 |
| 78 | gnl\|Fabrus\|VH1-46__IGHD1-26*01__IGHJ4*01 | 486 | 1091 | gnl\|Fabrus\|O12__IGKJ1*01 | 833 | 1438 |
| 79 | gnl\|Fabrus\|VH7-81__IGHD2-21*01__IGHJ6*01 | 800 | 1405 | gnl\|Fabrus\|O12__IGKJ1*01 | 833 | 1438 |
| 80 | gnl\|Fabrus\|VH2-70__IGHD3-9*01__IGHJ6*01 | 542 | 1147 | gnl\|Fabrus\|O12__IGKJ1*01 | 833 | 1438 |
| 81 | gnl\|Fabrus\|VH1-58__IGHD3-10*01__IGHJ6*01 | 496 | 1101 | gnl\|Fabrus\|O12__IGKJ1*01 | 833 | 1438 |
| 82 | gnl\|Fabrus\|VH7-81__IGHD2-21*01__IGHJ2*01 | 799 | 1404 | gnl\|Fabrus\|O12__IGKJ1*01 | 833 | 1438 |
| 83 | gnl\|Fabrus\|VH4-28__IGHD3-9*01__IGHJ6*01 | 734 | 1339 | gnl\|Fabrus\|O12__IGKJ1*01 | 833 | 1438 |
| 84 | gnl\|Fabrus\|VH4-31__IGHD2-15*01__IGHJ2*01 | 740 | 1345 | gnl\|Fabrus\|O12__IGKJ1*01 | 833 | 1438 |
| 85 | gnl\|Fabrus\|VH2-5__IGHD3-9*01__IGHJ6*01 | 535 | 1140 | gnl\|Fabrus\|O12__IGKJ1*01 | 833 | 1438 |
| 86 | gnl\|Fabrus\|VH1-8__IGHD2-15*01__IGHJ6*01 | 515 | 1120 | gnl\|Fabrus\|O12__IGKJ1*01 | 833 | 1438 |
| 87 | gnl\|Fabrus\|VH2-70__IGHD2-15*01__IGHJ2*01 | 540 | 1145 | gnl\|Fabrus\|O12__IGKJ1*01 | 833 | 1438 |
| 88 | gnl\|Fabrus\|VH3-38__IGHD3-10*01__IGHJ4*01 | 639 | 1244 | gnl\|Fabrus\|O12__IGKJ1*01 | 833 | 1438 |
| 89 | gnl\|Fabrus\|VH3-16__IGHD1-7*01__IGHJ6*01 | 570 | 1175 | gnl\|Fabrus\|O12__IGKJ1*01 | 833 | 1438 |
| 90 | gnl\|Fabrus\|VH3-73__IGHD3-9*01__IGHJ6*01 | 706 | 1311 | gnl\|Fabrus\|O12__IGKJ1*01 | 833 | 1438 |
| 91 | gnl\|Fabrus\|VH3-11__IGHD3-9*01__IGHJ6*01 | 548 | 1153 | gnl\|Fabrus\|O12__IGKJ1*01 | 833 | 1438 |
| 92 | gnl\|Fabrus\|VH3-11__IGHD6-6*01__IGHJ1*01 | 552 | 1157 | gnl\|Fabrus\|O12__IGKJ1*01 | 833 | 1438 |
| 93 | gnl\|Fabrus\|VH3-20__IGHD5-12*01__IGHJ4*01 | 584 | 1189 | gnl\|Fabrus\|O12__IGKJ1*01 | 833 | 1438 |
| 94 | gnl\|Fabrus\|VH3-16__IGHD2-15*01__IGHJ2*01 | 571 | 1176 | gnl\|Fabrus\|O12__IGKJ1*01 | 833 | 1438 |
| 95 | gnl\|Fabrus\|VH3-7__IGHD6-6*01__IGHJ1*01 | 692 | 1297 | gnl\|Fabrus\|O12__IGKJ1*01 | 833 | 1438 |
| 96 | gnl\|Fabrus\|VH3-16__IGHD6-13*01__IGHJ4*01 | 576 | 1181 | gnl\|Fabrus\|O12__IGKJ1*01 | 833 | 1438 |
| 97 | gnl\|Fabrus\|VH3-23__IGHD1-1*01__IGHJ4*01 | 595 | 1200 | gnl\|Fabrus\|O18__IGKJ1*01 | 834 | 1439 |
| 98 | gnl\|Fabrus\|VH3-23__IGHD2-15*01__IGHJ4*01 | 598 | 1203 | gnl\|Fabrus\|O18__IGKJ1*01 | 834 | 1439 |
| 99 | gnl\|Fabrus\|VH3-23__IGHD3-22*01__IGHJ4*01 | 602 | 1207 | gnl\|Fabrus\|O18__IGKJ1*01 | 834 | 1439 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 100 | gnl\|Fabrus\|VH3-23__IGHD4-11*01__IGHJ4*01 | 604 | 1209 | gnl\|Fabrus\|O18__IGKJ1*01 | 834 | 1439 |
| 101 | gnl\|Fabrus\|VH3-23__IGHD5-12*01__IGHJ4*01 | 606 | 1211 | gnl\|Fabrus\|O18__IGKJ1*01 | 834 | 1439 |
| 102 | gnl\|Fabrus\|VH3-23__IGHD5-5*01__IGHJ4*01 | 608 | 1213 | gnl\|Fabrus\|O18__IGKJ1*01 | 834 | 1439 |
| 103 | gnl\|Fabrus\|VH3-23__IGHD6-13*01__IGHJ4*01 | 609 | 1214 | gnl\|Fabrus\|O18__IGKJ1*01 | 834 | 1439 |
| 104 | gnl\|Fabrus\|VH3-23__IGHD7-27*01__IGHJ4*01 | 612 | 1217 | gnl\|Fabrus\|O18__IGKJ1*01 | 834 | 1439 |
| 105 | gnl\|Fabrus\|VH3-23__IGHD7-27*01__IGHJ6*01 | 613 | 1218 | gnl\|Fabrus\|O18__IGKJ1*01 | 834 | 1439 |
| 106 | gnl\|Fabrus\|VH1-69__GHD1-14*01__IGHJ4*01 | 502 | 1107 | gnl\|Fabrus\|O18__IGKJ1*01 | 834 | 1439 |
| 107 | gnl\|Fabrus\|VH1-69__IGHD2-2*01__IGHJ4*01 | 503 | 1108 | gnl\|Fabrus\|O18__IGKJ1*01 | 834 | 1439 |
| 108 | gnl\|Fabrus\|VH1-69__IGHD2-8*01__IGHJ6*01 | 504 | 1109 | gnl\|Fabrus\|O18__IGKJ1*01 | 834 | 1439 |
| 109 | gnl\|Fabrus\|VH1-69__IGHD3-16*01__IGHJ4*01 | 505 | 1110 | gnl\|Fabrus\|O18__IGKJ1*01 | 834 | 1439 |
| 110 | gnl\|Fabrus\|VH1-69__IGHD3-3*01__IGHJ4*01 | 506 | 1111 | gnl\|Fabrus\|O18__IGKJ1*01 | 834 | 1439 |
| 111 | gnl\|Fabrus\|VH1-69__IGHD4-17*01__IGHJ4*01 | 508 | 1113 | gnl\|Fabrus\|O18__IGKJ1*01 | 834 | 1439 |
| 112 | gnl\|Fabrus\|VH1-69__IGHD5-12*01__IGHJ4*01 | 509 | 1114 | gnl\|Fabrus\|O18__IGKJ1*01 | 834 | 1439 |
| 113 | gnl\|Fabrus\|VH1-69__IGHD6-19*01__IGHJ4*01 | 511 | 1116 | gnl\|Fabrus\|O18__IGKJ1*01 | 834 | 1439 |
| 114 | gnl\|Fabrus\|VH1-69__IGHD7-27*01__IGHJ4*01 | 513 | 1118 | gnl\|Fabrus\|O18__IGKJ1*01 | 834 | 1439 |
| 115 | gnl\|Fabrus\|VH4-34__IGHD1-7*01__IGHJ4*01 | 749 | 1354 | gnl\|Fabrus\|O18__IGKJ1*01 | 834 | 1439 |
| 116 | gnl\|Fabrus\|VH4-34__IGHD2-2*01__IGHJ4*01 | 750 | 1355 | gnl\|Fabrus\|O18__IGKJ1*01 | 834 | 1439 |
| 117 | gnl\|Fabrus\|VH4-34__IGHD3-16*01__IGHJ4*01 | 751 | 1356 | gnl\|Fabrus\|O18__IGKJ1*01 | 834 | 1439 |
| 118 | gnl\|Fabrus\|VH4-34__IGHD4-17*01__IGHJ4*01 | 753 | 1358 | gnl\|Fabrus\|O18__IGKJ1*01 | 834 | 1439 |
| 119 | gnl\|Fabrus\|VH4-34__IGHD5-12*01__IGHJ4*01 | 754 | 1359 | gnl\|Fabrus\|O18__IGKJ1*01 | 834 | 1439 |
| 120 | gnl\|Fabrus\|VH4-34__IGHD6-13*01__IGHJ4*01 | 755 | 1360 | gnl\|Fabrus\|O18__IGKJ1*01 | 834 | 1439 |
| 121 | gnl\|Fabrus\|VH4-34__IGHD6-25*01__IGHJ6*01 | 756 | 1361 | gnl\|Fabrus\|O18__IGKJ1*01 | 834 | 1439 |
| 122 | gnl\|Fabrus\|VH4-34__IGHD7-27*01__IGHJ4*01 | 758 | 1363 | gnl\|Fabrus\|O18__IGKJ1*01 | 834 | 1439 |
| 123 | gnl\|Fabrus\|VH2-26__IGHD1-20*01__IGHJ4*01 | 521 | 1126 | gnl\|Fabrus\|O18__IGKJ1*01 | 834 | 1439 |
| 124 | gnl\|Fabrus\|VH2-26__IGHD2-2*01__IGHJ4*01 | 523 | 1128 | gnl\|Fabrus\|O18__IGKJ1*01 | 834 | 1439 |
| 125 | gnl\|Fabrus\|VH2-26__IGHD3-10*01__IGHJ4*01 | 524 | 1129 | gnl\|Fabrus\|O18__IGKJ1*01 | 834 | 1439 |
| 126 | gnl\|Fabrus\|VH2-26__IGHD4-11*01__IGHJ4*01 | 526 | 1131 | gnl\|Fabrus\|O18__IGKJ1*01 | 834 | 1439 |
| 127 | gnl\|Fabrus\|VH2-26__IGHD5-18*01__IGHJ4*01 | 528 | 1133 | gnl\|Fabrus\|O18__IGKJ1*01 | 834 | 1439 |
| 128 | gnl\|Fabrus\|VH2-26__IGHD6-13*01__IGHJ4*01 | 529 | 1134 | gnl\|Fabrus\|O18__IGKJ1*01 | 834 | 1439 |
| 129 | gnl\|Fabrus\|VH2-26__IGHD7-27*01__IGHJ4*01 | 530 | 1135 | gnl\|Fabrus\|O18__IGKJ1*01 | 834 | 1439 |
| 130 | gnl\|Fabrus\|VH5-51__IGHD1-14*01__IGHJ4*01 | 776 | 1381 | gnl\|Fabrus\|O18__IGKJ1*01 | 834 | 1439 |
| 131 | gnl\|Fabrus\|VH5-51__IGHD2-8*01__IGHJ4*01 | 778 | 1383 | gnl\|Fabrus\|O18__IGKJ1*01 | 834 | 1439 |
| 132 | gnl\|Fabrus\|VH5-51__IGHD3-3*01__IGHJ4*01 | 780 | 1385 | gnl\|Fabrus\|O18__IGKJ1*01 | 834 | 1439 |
| 133 | gnl\|Fabrus\|VH5-51__IGHD4-17*01__IGHJ4*01 | 781 | 1386 | gnl\|Fabrus\|O18__IGKJ1*01 | 834 | 1439 |
| 134 | gnl\|Fabrus\|VH5-51__IGHD5-18*01>3__IGHJ4*01 | 782 | 1387 | gnl\|Fabrus\|O18__IGKJ1*01 | 834 | 1439 |
| 135 | gnl\|Fabrus\|VH5-51__IGHD5-18*01>1__IGHJ4*01 | 783 | 1388 | gnl\|Fabrus\|O18__IGKJ1*01 | 834 | 1439 |
| 136 | gnl\|Fabrus\|VH5-51__IGHD6-25*01__IGHJ4*01 | 784 | 1389 | gnl\|Fabrus\|O18__IGKJ1*01 | 834 | 1439 |
| 137 | gnl\|Fabrus\|VH5-51__IGHD7-27*01__IGHJ4*01 | 785 | 1390 | gnl\|Fabrus\|O18__IGKJ1*01 | 834 | 1439 |
| 138 | gnl\|Fabrus\|VH6-1__IGHD1-1*01__IGHJ4*01 | 786 | 1391 | gnl\|Fabrus\|O18__IGKJ1*01 | 834 | 1439 |
| 139 | gnl\|Fabrus\|VH6-1__IGHD2-15*01__IGHJ4*01 | 788 | 1393 | gnl\|Fabrus\|O18__IGKJ1*01 | 834 | 1439 |
| 140 | gnl\|Fabrus\|VH6-1__IGHD3-3*01__IGHJ4*01 | 791 | 1396 | gnl\|Fabrus\|O18__IGKJ1*01 | 834 | 1439 |
| 141 | gnl\|Fabrus\|VH6-1__IGHD4-23*01__IGHJ4*01 | 793 | 1398 | gnl\|Fabrus\|O18__IGKJ1*01 | 834 | 1439 |
| 142 | gnl\|Fabrus\|VH6-1__IGHD4-11*01__IGHJ6*01 | 792 | 1397 | gnl\|Fabrus\|O18__IGKJ1*01 | 834 | 1439 |
| 143 | gnl\|Fabrus\|VH6-1__IGHD5-5*01__IGHJ4*01 | 794 | 1399 | gnl\|Fabrus\|O18__IGKJ1*01 | 834 | 1439 |
| 144 | gnl\|Fabrus\|VH6-1__IGHD6-13*01__IGHJ4*01 | 795 | 1400 | gnl\|Fabrus\|O18__IGKJ1*01 | 834 | 1439 |
| 145 | gnl\|Fabrus\|VH6-1__IGHD6-25*01__IGHJ6*01 | 796 | 1401 | gnl\|Fabrus\|O18__IGKJ1*01 | 834 | 1439 |
| 146 | gnl\|Fabrus\|VH6-1__IGHD7-27*01__IGHJ4*01 | 797 | 1402 | gnl\|Fabrus\|O18__IGKJ1*01 | 834 | 1439 |
| 147 | gnl\|Fabrus\|VH4-59__IGHD6-25*01__IGHJ3*01 | 775 | 1380 | gnl\|Fabrus\|O18__IGKJ1*01 | 834 | 1439 |
| 148 | gnl\|Fabrus\|VH3-48__IGHD6-6*01__IGHJ1*01 | 655 | 1260 | gnl\|Fabrus\|O18__IGKJ1*01 | 834 | 1439 |
| 149 | gnl\|Fabrus\|VH3-30__IGHD6-6*01__IGHJ1*01 | 625 | 1230 | gnl\|Fabrus\|O18__IGKJ1*01 | 834 | 1439 |
| 150 | gnl\|Fabrus\|VH3-66__IGHD6-6*01__IGHJ1*01 | 681 | 1286 | gnl\|Fabrus\|O18__IGKJ1*01 | 834 | 1439 |
| 151 | gnl\|Fabrus\|VH3-53__IGHD5-5*01__IGHJ4*01 | 670 | 1275 | gnl\|Fabrus\|O18__IGKJ1*01 | 834 | 1439 |
| 152 | gnl\|Fabrus\|VH2-5__IGHD5-12*01__IGHJ4*01 | 536 | 1141 | gnl\|Fabrus\|O18__IGKJ1*01 | 834 | 1439 |
| 153 | gnl\|Fabrus\|VH2-70__IGHD5-12*01__IGHJ4*01 | 543 | 1148 | gnl\|Fabrus\|O18__IGKJ1*01 | 834 | 1439 |
| 154 | gnl\|Fabrus\|VH3-15__IGHD5-12*01__IGHJ4*01 | 567 | 1172 | gnl\|Fabrus\|O18__IGKJ1*01 | 834 | 1439 |
| 155 | gnl\|Fabrus\|VH3-15__IGHD3-10*01__IGHJ4*01 | 565 | 1170 | gnl\|Fabrus\|O18__IGKJ1*01 | 834 | 1439 |
| 156 | gnl\|Fabrus\|VH3-49__IGHD5-18*01__IGHJ4*01 | 662 | 1267 | gnl\|Fabrus\|O18__IGKJ1*01 | 834 | 1439 |
| 157 | gnl\|Fabrus\|VH3-49__IGHD6-13*01__IGHJ4*01 | 663 | 1268 | gnl\|Fabrus\|O18__IGKJ1*01 | 834 | 1439 |
| 158 | gnl\|Fabrus\|VH3-72__IGHD5-18*01__IGHJ4*01 | 699 | 1304 | gnl\|Fabrus\|O18__IGKJ1*01 | 834 | 1439 |
| 159 | gnl\|Fabrus\|VH3-72__IGHD6-6*01__IGHJ1*01 | 701 | 1306 | gnl\|Fabrus\|O18__IGKJ1*01 | 834 | 1439 |
| 160 | gnl\|Fabrus\|VH3-73__IGHD5-12*01__IGHJ4*01 | 709 | 1314 | gnl\|Fabrus\|O18__IGKJ1*01 | 834 | 1439 |
| 161 | gnl\|Fabrus\|VH3-73__IGHD4-23*01__IGHJ5*01 | 708 | 1313 | gnl\|Fabrus\|O18__IGKJ1*01 | 834 | 1439 |
| 162 | gnl\|Fabrus\|VH3-43__IGHD3-22*01__IGHJ4*01 | 650 | 1255 | gnl\|Fabrus\|O18__IGKJ1*01 | 834 | 1439 |
| 163 | gnl\|Fabrus\|VH3-43__IGHD6-13*01__IGHJ4*01 | 653 | 1258 | gnl\|Fabrus\|O18__IGKJ1*01 | 834 | 1439 |
| 164 | gnl\|Fabrus\|VH3-9__IGHD3-22*01__IGHJ4*01 | 724 | 1329 | gnl\|Fabrus\|O18__IGKJ1*01 | 834 | 1439 |
| 165 | gnl\|Fabrus\|VH3-9__IGHD1-7*01__IGHJ5*01 | 721 | 1326 | gnl\|Fabrus\|O18__IGKJ1*01 | 834 | 1439 |
| 166 | gnl\|Fabrus\|VH3-9__IGHD6-13*01__IGHJ4*01 | 727 | 1332 | gnl\|Fabrus\|O18__IGKJ1*01 | 834 | 1439 |
| 167 | gnl\|Fabrus\|VH4-39__IGHD3-10*01__IGHJ4*01 | 762 | 1367 | gnl\|Fabrus\|O18__IGKJ1*01 | 834 | 1439 |
| 168 | gnl\|Fabrus\|VH4-39__IGHD5-12*01__IGHJ4*01 | 766 | 1371 | gnl\|Fabrus\|O18__IGKJ1*01 | 834 | 1439 |
| 169 | gnl\|Fabrus\|VH1-18__IGHD6-6*01__IGHJ1*01 | 460 | 1065 | gnl\|Fabrus\|O18__IGKJ1*01 | 834 | 1439 |
| 170 | gnl\|Fabrus\|VH1-24__IGHD5-12*01__IGHJ4*01 | 467 | 1072 | gnl\|Fabrus\|O18__IGKJ1*01 | 834 | 1439 |
| 171 | gnl\|Fabrus\|VH1-2__IGHD1-1*01__IGHJ3*01 | 461 | 1066 | gnl\|Fabrus\|O18__IGKJ1*01 | 834 | 1439 |
| 172 | gnl\|Fabrus\|VH1-3__IGHD6-6*01__IGHJ1*01 | 475 | 1080 | gnl\|Fabrus\|O18__IGKJ1*01 | 834 | 1439 |
| 173 | gnl\|Fabrus\|VH1-45__IGHD3-10*01__IGHJ4*01 | 480 | 1085 | gnl\|Fabrus\|O18__IGKJ1*01 | 834 | 1439 |
| 174 | gnl\|Fabrus\|VH1-46__IGHD1-26*01__IGHJ4*01 | 486 | 1091 | gnl\|Fabrus\|O18__IGKJ1*01 | 834 | 1439 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 175 | gnl\|Fabrus\|VH7-81__IGHD2-21*01__IGHJ6*01 | 800 | 1405 | gnl\|Fabrus\|O18__IGKJ1*01 | 834 | 1439 |
| 176 | gnl\|Fabrus\|VH2-70__IGHD3-9*01__IGHJ6*01 | 542 | 1147 | gnl\|Fabrus\|O18__IGKJ1*01 | 834 | 1439 |
| 177 | gnl\|Fabrus\|VH1-58__IGHD3-10*01__IGHJ6*01 | 496 | 1101 | gnl\|Fabrus\|O18__IGKJ1*01 | 834 | 1439 |
| 178 | gnl\|Fabrus\|VH7-81__IGHD2-21*01__IGHJ2*01 | 799 | 1404 | gnl\|Fabrus\|O18__IGKJ1*01 | 834 | 1439 |
| 179 | gnl\|Fabrus\|VH4-28__IGHD3-9*01__IGHJ6*01 | 734 | 1339 | gnl\|Fabrus\|O18__IGKJ1*01 | 834 | 1439 |
| 180 | gnl\|Fabrus\|VH4-31__IGHD2-15*01__IGHJ2*01 | 740 | 1345 | gnl\|Fabrus\|O18__IGKJ1*01 | 834 | 1439 |
| 181 | gnl\|Fabrus\|VH2-5__IGHD3-9*01__IGHJ6*01 | 535 | 1140 | gnl\|Fabrus\|O18__IGKJ1*01 | 834 | 1439 |
| 182 | gnl\|Fabrus\|VH1-8__IGHD2-15*01__IGHJ6*01 | 515 | 1120 | gnl\|Fabrus\|O18__IGKJ1*01 | 834 | 1439 |
| 183 | gnl\|Fabrus\|VH2-70__IGHD2-15*01__IGHJ2*01 | 540 | 1145 | gnl\|Fabrus\|O18__IGKJ1*01 | 834 | 1439 |
| 184 | gnl\|Fabrus\|VH3-38__IGHD3-10*01__IGHJ4*01 | 639 | 1244 | gnl\|Fabrus\|O18__IGKJ1*01 | 834 | 1439 |
| 185 | gnl\|Fabrus\|VH3-16__IGHD1-7*01__IGHJ6*01 | 570 | 1175 | gnl\|Fabrus\|O18__IGKJ1*01 | 834 | 1439 |
| 186 | gnl\|Fabrus\|VH3-73__IGHD3-9*01__IGHJ6*01 | 706 | 1311 | gnl\|Fabrus\|O18__IGKJ1*01 | 834 | 1439 |
| 187 | gnl\|Fabrus\|VH3-11__IGHD3-9*01__IGHJ6*01 | 548 | 1153 | gnl\|Fabrus\|O18__IGKJ1*01 | 834 | 1439 |
| 188 | gnl\|Fabrus\|VH3-11__IGHD6-6*01__IGHJ1*01 | 552 | 1157 | gnl\|Fabrus\|O18__IGKJ1*01 | 834 | 1439 |
| 189 | gnl\|Fabrus\|VH3-20__IGHD5-12*01__IGHJ4*01 | 584 | 1189 | gnl\|Fabrus\|O18__IGKJ1*01 | 834 | 1439 |
| 190 | gnl\|Fabrus\|VH3-16__IGHD2-15*01__IGHJ2*01 | 571 | 1176 | gnl\|Fabrus\|O18__IGKJ1*01 | 834 | 1439 |
| 191 | gnl\|Fabrus\|VH3-7__IGHD6-6*01__IGHJ1*01 | 692 | 1297 | gnl\|Fabrus\|O18__IGKJ1*01 | 834 | 1439 |
| 192 | gnl\|Fabrus\|VH3-16__IGHD6-13*01__IGHJ4*01 | 576 | 1181 | gnl\|Fabrus\|O18__IGKJ1*01 | 834 | 1439 |
| 193 | gnl\|Fabrus\|VH3-23__IGHD1-1*01__IGHJ4*01 | 595 | 1200 | gnl\|Fabrus\|A20__IGKJ1*01 | 809 | 1414 |
| 194 | gnl\|Fabrus\|VH3-23__IGHD2-15*01__IGHJ4*01 | 598 | 1203 | gnl\|Fabrus\|A20__IGKJ1*01 | 809 | 1414 |
| 195 | gnl\|Fabrus\|VH3-23__IGHD3-22*01__IGHJ4*01 | 602 | 1207 | gnl\|Fabrus\|A20__IGKJ1*01 | 809 | 1414 |
| 196 | gnl\|Fabrus\|VH3-23__IGHD4-11*01__IGHJ4*01 | 604 | 1209 | gnl\|Fabrus\|A20__IGKJ1*01 | 809 | 1414 |
| 197 | gnl\|Fabrus\|VH3-23__IGHD5-12*01__IGHJ4*01 | 606 | 1211 | gnl\|Fabrus\|A20__IGKJ1*01 | 809 | 1414 |
| 198 | gnl\|Fabrus\|VH3-23__IGHD5-5*01__IGHJ4*01 | 608 | 1213 | gnl\|Fabrus\|A20__IGKJ1*01 | 809 | 1414 |
| 199 | gnl\|Fabrus\|VH3-23__IGHD6-13*01__IGHJ4*01 | 609 | 1214 | gnl\|Fabrus\|A20__IGKJ1*01 | 809 | 1414 |
| 200 | gnl\|Fabrus\|VH3-23__IGHD7-27*01__IGHJ4*01 | 612 | 1217 | gnl\|Fabrus\|A20__IGKJ1*01 | 809 | 1414 |
| 201 | gnl\|Fabrus\|VH3-23__IGHD7-27*01__IGHJ6*01 | 613 | 1218 | gnl\|Fabrus\|A20__IGKJ1*01 | 809 | 1414 |
| 202 | gnl\|Fabrus\|VH1-69__IGHD1-14*01__IGHJ4*01 | 502 | 1107 | gnl\|Fabrus\|A20__IGKJ1*01 | 809 | 1414 |
| 203 | gnl\|Fabrus\|VH1-69__IGHD2-2*01__IGHJ4*01 | 503 | 1108 | gnl\|Fabrus\|A20__IGKJ1*01 | 809 | 1414 |
| 204 | gnl\|Fabrus\|VH1-69__IGHD2-8*01__IGHJ6*01 | 504 | 1109 | gnl\|Fabrus\|A20__IGKJ1*01 | 809 | 1414 |
| 205 | gnl\|Fabrus\|VH1-69__IGHD3-16*01__IGHJ4*01 | 505 | 1110 | gnl\|Fabrus\|A20__IGKJ1*01 | 809 | 1414 |
| 206 | gnl\|Fabrus\|VH1-69__IGHD3-3*01__IGHJ4*01 | 506 | 1111 | gnl\|Fabrus\|A20__IGKJ1*01 | 809 | 1414 |
| 207 | gnl\|Fabrus\|VH1-69__IGHD4-17*01__IGHJ4*01 | 508 | 1113 | gnl\|Fabrus\|A20__IGKJ1*01 | 809 | 1414 |
| 208 | gnl\|Fabrus\|VH1-69__IGHD5-12*01__IGHJ4*01 | 509 | 1114 | gnl\|Fabrus\|A20__IGKJ1*01 | 809 | 1414 |
| 209 | gnl\|Fabrus\|VH1-69__IGHD6-19*01__IGHJ4*01 | 511 | 1116 | gnl\|Fabrus\|A20__IGKJ1*01 | 809 | 1414 |
| 210 | gnl\|Fabrus\|VH1-69__IGHD7-27*01__IGHJ4*01 | 513 | 1118 | gnl\|Fabrus\|A20__IGKJ1*01 | 809 | 1414 |
| 211 | gnl\|Fabrus\|VH4-34__IGHD1-7*01__IGHJ4*01 | 749 | 1354 | gnl\|Fabrus\|A20__IGKJ1*01 | 809 | 1414 |
| 212 | gnl\|Fabrus\|VH4-34__IGHD2-2*01__IGHJ4*01 | 750 | 1355 | gnl\|Fabrus\|A20__IGKJ1*01 | 809 | 1414 |
| 213 | gnl\|Fabrus\|VH4-34__IGHD3-16*01__IGHJ4*01 | 751 | 1356 | gnl\|Fabrus\|A20__IGKJ1*01 | 809 | 1414 |
| 214 | gnl\|Fabrus\|VH4-34__IGHD4-17*01__IGHJ4*01 | 753 | 1358 | gnl\|Fabrus\|A20__IGKJ1*01 | 809 | 1414 |
| 215 | gnl\|Fabrus\|VH4-34__IGHD5-12*01__IGHJ4*01 | 754 | 1359 | gnl\|Fabrus\|A20__IGKJ1*01 | 809 | 1414 |
| 216 | gnl\|Fabrus\|VH4-34__IGHD6-13*01__IGHJ4*01 | 755 | 1360 | gnl\|Fabrus\|A20__IGKJ1*01 | 809 | 1414 |
| 217 | gnl\|Fabrus\|VH4-34__IGHD6-25*01__IGHJ6*01 | 756 | 1361 | gnl\|Fabrus\|A20__IGKJ1*01 | 809 | 1414 |
| 218 | gnl\|Fabrus\|VH4-34__IGHD7-27*01__IGHJ4*01 | 758 | 1363 | gnl\|Fabrus\|A20__IGKJ1*01 | 809 | 1414 |
| 219 | gnl\|Fabrus\|VH2-26__IGHD1-20*01__IGHJ4*01 | 521 | 1126 | gnl\|Fabrus\|A20__IGKJ1*01 | 809 | 1414 |
| 220 | gnl\|Fabrus\|VH2-26__IGHD2-2*01__IGHJ4*01 | 523 | 1128 | gnl\|Fabrus\|A20__IGKJ1*01 | 809 | 1414 |
| 221 | gnl\|Fabrus\|VH2-26__IGHD3-10*01__IGHJ4*01 | 524 | 1129 | gnl\|Fabrus\|A20__IGKJ1*01 | 809 | 1414 |
| 222 | gnl\|Fabrus\|VH2-26__IGHD4-11*01__IGHJ4*01 | 526 | 1131 | gnl\|Fabrus\|A20__IGKJ1*01 | 809 | 1414 |
| 223 | gnl\|Fabrus\|VH2-26__IGHD5-18*01__IGHJ4*01 | 528 | 1133 | gnl\|Fabrus\|A20__IGKJ1*01 | 809 | 1414 |
| 224 | gnl\|Fabrus\|VH2-26__IGHD6-13*01__IGHJ4*01 | 529 | 1134 | gnl\|Fabrus\|A20__IGKJ1*01 | 809 | 1414 |
| 225 | gnl\|Fabrus\|VH2-26__IGHD7-27*01__IGHJ4*01 | 530 | 1135 | gnl\|Fabrus\|A20__IGKJ1*01 | 809 | 1414 |
| 226 | gnl\|Fabrus\|VH5-51__IGHD1-14*01__IGHJ4*01 | 776 | 1381 | gnl\|Fabrus\|A20__IGKJ1*01 | 809 | 1414 |
| 227 | gnl\|Fabrus\|VH5-51__IGHD2-8*01__IGHJ4*01 | 778 | 1383 | gnl\|Fabrus\|A20__IGKJ1*01 | 809 | 1414 |
| 228 | gnl\|Fabrus\|VH5-51__IGHD3-3*01__IGHJ4*01 | 780 | 1385 | gnl\|Fabrus\|A20__IGKJ1*01 | 809 | 1414 |
| 229 | gnl\|Fabrus\|VH5-51__IGHD4-17*01__IGHJ4*01 | 781 | 1386 | gnl\|Fabrus\|A20__IGKJ1*01 | 809 | 1414 |
| 230 | gnl\|Fabrus\|VH5-51__IGHD5-18*01>3__IGHJ4*01 | 782 | 1387 | gnl\|Fabrus\|A20__IGKJ1*01 | 809 | 1414 |
| 231 | gnl\|Fabrus\|VH5-51__IGHD5-18*01>1__IGHJ4*01 | 783 | 1388 | gnl\|Fabrus\|A20__IGKJ1*01 | 809 | 1414 |
| 232 | gnl\|Fabrus\|VH5-51__IGHD6-25*01__IGHJ4*01 | 784 | 1389 | gnl\|Fabrus\|A20__IGKJ1*01 | 809 | 1414 |
| 233 | gnl\|Fabrus\|VH5-51__IGHD7-27*01__IGHJ4*01 | 785 | 1390 | gnl\|Fabrus\|A20__IGKJ1*01 | 809 | 1414 |
| 234 | gnl\|Fabrus\|VH6-1__IGHD1-1*01__IGHJ4*01 | 786 | 1391 | gnl\|Fabrus\|A20__IGKJ1*01 | 809 | 1414 |
| 235 | gnl\|Fabrus\|VH6-1__IGHD2-15*01__IGHJ4*01 | 788 | 1393 | gnl\|Fabrus\|A20__IGKJ1*01 | 809 | 1414 |
| 236 | gnl\|Fabrus\|VH6-1__IGHD3-3*01__IGHJ4*01 | 791 | 1396 | gnl\|Fabrus\|A20__IGKJ1*01 | 809 | 1414 |
| 237 | gnl\|Fabrus\|VH6-1__IGHD4-23*01__IGHJ4*01 | 793 | 1398 | gnl\|Fabrus\|A20__IGKJ1*01 | 809 | 1414 |
| 238 | gnl\|Fabrus\|VH6-1__IGHD4-11*01__IGHJ6*01 | 792 | 1397 | gnl\|Fabrus\|A20__IGKJ1*01 | 809 | 1414 |
| 239 | gnl\|Fabrus\|VH6-1__IGHD5-5*01__IGHJ4*01 | 794 | 1399 | gnl\|Fabrus\|A20__IGKJ1*01 | 809 | 1414 |
| 240 | gnl\|Fabrus\|VH6-1__IGHD6-13*01__IGHJ4*01 | 795 | 1400 | gnl\|Fabrus\|A20__IGKJ1*01 | 809 | 1414 |
| 241 | gnl\|Fabrus\|VH6-1__IGHD6-25*01__IGHJ6*01 | 796 | 1401 | gnl\|Fabrus\|A20__IGKJ1*01 | 809 | 1414 |
| 242 | gnl\|Fabrus\|VH6-1__IGHD7-27*01__IGHJ4*01 | 797 | 1402 | gnl\|Fabrus\|A20__IGKJ1*01 | 809 | 1414 |
| 243 | gnl\|Fabrus\|VH4-59__IGHD6-25*01__IGHJ3*01 | 775 | 1380 | gnl\|Fabrus\|A20__IGKJ1*01 | 809 | 1414 |
| 244 | gnl\|Fabrus\|VH3-48__IGHD6-6*01__IGHJ1*01 | 655 | 1260 | gnl\|Fabrus\|A20__IGKJ1*01 | 809 | 1414 |
| 245 | gnl\|Fabrus\|VH3-30__IGHD6-6*01__IGHJ1*01 | 625 | 1230 | gnl\|Fabrus\|A20__IGKJ1*01 | 809 | 1414 |
| 246 | gnl\|Fabrus\|VH3-66__IGHD6-6*01__IGHJ1*01 | 681 | 1286 | gnl\|Fabrus\|A20__IGKJ1*01 | 809 | 1414 |
| 247 | gnl\|Fabrus\|VH3-53__IGHD5-5*01__IGHJ4*01 | 670 | 1275 | gnl\|Fabrus\|A20__IGKJ1*01 | 809 | 1414 |
| 248 | gnl\|Fabrus\|VH2-5__IGHD5-12*01__IGHJ4*01 | 536 | 1141 | gnl\|Fabrus\|A20__IGKJ1*01 | 809 | 1414 |
| 249 | gnl\|Fabrus\|VH2-70__IGHD5-12*01__IGHJ4*01 | 543 | 1148 | gnl\|Fabrus\|A20__IGKJ1*01 | 809 | 1414 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 250 | gnl\|Fabrus\|VH3-15__IGHD5-12*01__IGHJ4*01 | 567 | 1172 | gnl\|Fabrus\|A20__IGKJ1*01 | 809 | 1414 |
| 251 | gnl\|Fabrus\|VH3-15__IGHD3-10*01__IGHJ4*01 | 565 | 1170 | gnl\|Fabrus\|A20__IGKJ1*01 | 809 | 1414 |
| 252 | gnl\|Fabrus\|VH3-49__IGHD5-18*01__IGHJ4*01 | 662 | 1267 | gnl\|Fabrus\|A20__IGKJ1*01 | 809 | 1414 |
| 253 | gnl\|Fabrus\|VH3-49__IGHD6-13*01__IGHJ4*01 | 663 | 1268 | gnl\|Fabrus\|A20__IGKJ1*01 | 809 | 1414 |
| 254 | gnl\|Fabrus\|VH3-72__IGHD5-18*01__IGHJ4*01 | 699 | 1304 | gnl\|Fabrus\|A20__IGKJ1*01 | 809 | 1414 |
| 255 | gnl\|Fabrus\|VH3-72__IGHD6-6*01__IGHJ1*01 | 701 | 1306 | gnl\|Fabrus\|A20__IGKJ1*01 | 809 | 1414 |
| 256 | gnl\|Fabrus\|VH3-73__IGHD5-12*01__IGHJ4*01 | 709 | 1314 | gnl\|Fabrus\|A20__IGKJ1*01 | 809 | 1414 |
| 257 | gnl\|Fabrus\|VH3-73__IGHD4-23*01__IGHJ5*01 | 708 | 1313 | gnl\|Fabrus\|A20__IGKJ1*01 | 809 | 1414 |
| 258 | gnl\|Fabrus\|VH3-43__IGHD3-22*01__IGHJ4*01 | 650 | 1255 | gnl\|Fabrus\|A20__IGKJ1*01 | 809 | 1414 |
| 259 | gnl\|Fabrus\|VH3-43__IGHD6-13*01__IGHJ4*01 | 653 | 1258 | gnl\|Fabrus\|A20__IGKJ1*01 | 809 | 1414 |
| 260 | gnl\|Fabrus\|VH3-9__IGHD3-22*01__IGHJ4*01 | 724 | 1329 | gnl\|Fabrus\|A20__IGKJ1*01 | 809 | 1414 |
| 261 | gnl\|Fabrus\|VH3-9__IGHD1-7*01__IGHJ5*01 | 721 | 1326 | gnl\|Fabrus\|A20__IGKJ1*01 | 809 | 1414 |
| 262 | gnl\|Fabrus\|VH3-9__IGHD6-13*01__IGHJ4*01 | 727 | 1332 | gnl\|Fabrus\|A20__IGKJ1*01 | 809 | 1414 |
| 263 | gnl\|Fabrus\|VH4-39__IGHD3-10*01__IGHJ4*01 | 762 | 1367 | gnl\|Fabrus\|A20__IGKJ1*01 | 809 | 1414 |
| 264 | gnl\|Fabrus\|VH4-39__IGHD5-12*01__IGHJ4*01 | 766 | 1371 | gnl\|Fabrus\|A20__IGKJ1*01 | 809 | 1414 |
| 265 | gnl\|Fabrus\|VH1-18__IGHD6-6*01__IGHJ1*01 | 460 | 1065 | gnl\|Fabrus\|A20__IGKJ1*01 | 809 | 1414 |
| 266 | gnl\|Fabrus\|VH1-24__IGHD5-12*01__IGHJ4*01 | 467 | 1072 | gnl\|Fabrus\|A20__IGKJ1*01 | 809 | 1414 |
| 267 | gnl\|Fabrus\|VH1-2__IGHD1-1*01__IGHJ3*01 | 461 | 1066 | gnl\|Fabrus\|A20__IGKJ1*01 | 809 | 1414 |
| 268 | gnl\|Fabrus\|VH1-3__IGHD6-6*01__IGHJ1*01 | 475 | 1080 | gnl\|Fabrus\|A20__IGKJ1*01 | 809 | 1414 |
| 269 | gnl\|Fabrus\|VH1-45__IGHD3-10*01__IGHJ4*01 | 480 | 1085 | gnl\|Fabrus\|A20__IGKJ1*01 | 809 | 1414 |
| 270 | gnl\|Fabrus\|VH1-46__IGHD1-26*01__IGHJ4*01 | 486 | 1091 | gnl\|Fabrus\|A20__IGKJ1*01 | 809 | 1414 |
| 271 | gnl\|Fabrus\|VH7-81__IGHD2-21*01__IGHJ6*01 | 800 | 1405 | gnl\|Fabrus\|A20__IGKJ1*01 | 809 | 1414 |
| 272 | gnl\|Fabrus\|VH2-70__IGHD3-9*01__IGHJ6*01 | 542 | 1147 | gnl\|Fabrus\|A20__IGKJ1*01 | 809 | 1414 |
| 273 | gnl\|Fabrus\|VH1-58__IGHD3-10*01__IGHJ6*01 | 496 | 1101 | gnl\|Fabrus\|A20__IGKJ1*01 | 809 | 1414 |
| 274 | gnl\|Fabrus\|VH7-81__IGHD2-21*01__IGHJ2*01 | 799 | 1404 | gnl\|Fabrus\|A20__IGKJ1*01 | 809 | 1414 |
| 275 | gnl\|Fabrus\|VH4-28__IGHD3-9*01__IGHJ6*01 | 734 | 1339 | gnl\|Fabrus\|A20__IGKJ1*01 | 809 | 1414 |
| 276 | gnl\|Fabrus\|VH4-31__IGHD2-15*01__IGHJ2*01 | 740 | 1345 | gnl\|Fabrus\|A20__IGKJ1*01 | 809 | 1414 |
| 277 | gnl\|Fabrus\|VH2-5__IGHD3-9*01__IGHJ6*01 | 535 | 1140 | gnl\|Fabrus\|A20__IGKJ1*01 | 809 | 1414 |
| 278 | gnl\|Fabrus\|VH1-8__IGHD2-15*01__IGHJ6*01 | 515 | 1120 | gnl\|Fabrus\|A20__IGKJ1*01 | 809 | 1414 |
| 279 | gnl\|Fabrus\|VH2-70__IGHD2-15*01__IGHJ2*01 | 540 | 1145 | gnl\|Fabrus\|A20__IGKJ1*01 | 809 | 1414 |
| 280 | gnl\|Fabrus\|VH3-38__IGHD3-10*01__IGHJ4*01 | 639 | 1244 | gnl\|Fabrus\|A20__IGKJ1*01 | 809 | 1414 |
| 281 | gnl\|Fabrus\|VH3-16__IGHD1-7*01__IGHJ6*01 | 570 | 1175 | gnl\|Fabrus\|A20__IGKJ1*01 | 809 | 1414 |
| 282 | gnl\|Fabrus\|VH3-73__IGHD3-9*01__IGHJ6*01 | 706 | 1311 | gnl\|Fabrus\|A20__IGKJ1*01 | 809 | 1414 |
| 283 | gnl\|Fabrus\|VH3-11__IGHD3-9*01__IGHJ6*01 | 548 | 1153 | gnl\|Fabrus\|A20__IGKJ1*01 | 809 | 1414 |
| 284 | gnl\|Fabrus\|VH3-11__IGHD6-6*01__IGHJ1*01 | 552 | 1157 | gnl\|Fabrus\|A20__IGKJ1*01 | 809 | 1414 |
| 285 | gnl\|Fabrus\|VH3-20__IGHD5-12*01__IGHJ4*01 | 584 | 1189 | gnl\|Fabrus\|A20__IGKJ1*01 | 809 | 1414 |
| 286 | gnl\|Fabrus\|VH3-16__IGHD2-15*01__IGHJ2*01 | 571 | 1176 | gnl\|Fabrus\|A20__IGKJ1*01 | 809 | 1414 |
| 287 | gnl\|Fabrus\|VH3-7__IGHD6-6*01__IGHJ1*01 | 692 | 1297 | gnl\|Fabrus\|A20__IGKJ1*01 | 809 | 1414 |
| 288 | gnl\|Fabrus\|VH3-16__IGHD6-13*01__IGHJ4*01 | 576 | 1181 | gnl\|Fabrus\|A20__IGKJ1*01 | 809 | 1414 |
| 289 | gnl\|Fabrus\|VH3-23__IGHD1-1*01__IGHJ4*01 | 595 | 1200 | gnl\|Fabrus\|A30__IGKJ1*01 | 814 | 1419 |
| 290 | gnl\|Fabrus\|VH3-23__IGHD2-15*01__IGHJ4*01 | 598 | 1203 | gnl\|Fabrus\|A30__IGKJ1*01 | 814 | 1419 |
| 291 | gnl\|Fabrus\|VH3-23__IGHD3-22*01__IGHJ4*01 | 602 | 1207 | gnl\|Fabrus\|A30__IGKJ1*01 | 814 | 1419 |
| 292 | gnl\|Fabrus\|VH3-23__IGHD4-11*01__IGHJ4*01 | 604 | 1209 | gnl\|Fabrus\|A30__IGKJ1*01 | 814 | 1419 |
| 293 | gnl\|Fabrus\|VH3-23__IGHD5-12*01__IGHJ4*01 | 606 | 1211 | gnl\|Fabrus\|A30__IGKJ1*01 | 814 | 1419 |
| 294 | gnl\|Fabrus\|VH3-23__IGHD5-5*01__IGHJ4*01 | 608 | 1213 | gnl\|Fabrus\|A30__IGKJ1*01 | 814 | 1419 |
| 295 | gnl\|Fabrus\|VH3-23__IGHD6-13*01__IGHJ4*01 | 609 | 1214 | gnl\|Fabrus\|A30__IGKJ1*01 | 814 | 1419 |
| 296 | gnl\|Fabrus\|VH3-23__IGHD7-27*01__IGHJ4*01 | 612 | 1217 | gnl\|Fabrus\|A30__IGKJ1*01 | 814 | 1419 |
| 297 | gnl\|Fabrus\|VH3-23__IGHD7-27*01__IGHJ6*01 | 613 | 1218 | gnl\|Fabrus\|A30__IGKJ1*01 | 814 | 1419 |
| 298 | gnl\|Fabrus\|VH1-69__IGHD1-14*01__IGHJ4*01 | 502 | 1107 | gnl\|Fabrus\|A30__IGKJ1*01 | 814 | 1419 |
| 299 | gnl\|Fabrus\|VH1-69__IGHD2-2*01__IGHJ4*01 | 503 | 1108 | gnl\|Fabrus\|A30__IGKJ1*01 | 814 | 1419 |
| 300 | gnl\|Fabrus\|VH1-69__IGHD2-8*01__IGHJ6*01 | 504 | 1109 | gnl\|Fabrus\|A30__IGKJ1*01 | 814 | 1419 |
| 301 | gnl\|Fabrus\|VH1-69__IGHD3-16*01__IGHJ4*01 | 505 | 1110 | gnl\|Fabrus\|A30__IGKJ1*01 | 814 | 1419 |
| 302 | gnl\|Fabrus\|VH1-69__IGHD3-3*01__IGHJ4*01 | 506 | 1111 | gnl\|Fabrus\|A30__IGKJ1*01 | 814 | 1419 |
| 303 | gnl\|Fabrus\|VH1-69__IGHD4-17*01__IGHJ4*01 | 508 | 1113 | gnl\|Fabrus\|A30__IGKJ1*01 | 814 | 1419 |
| 304 | gnl\|Fabrus\|VH1-69__IGHD5-12*01__IGHJ4*01 | 509 | 1114 | gnl\|Fabrus\|A30__IGKJ1*01 | 814 | 1419 |
| 305 | gnl\|Fabrus\|VH1-69__IGHD6-19*01__IGHJ4*01 | 511 | 1116 | gnl\|Fabrus\|A30__IGKJ1*01 | 814 | 1419 |
| 306 | gnl\|Fabrus\|VH1-69__IGHD7-27*01__IGHJ4*01 | 513 | 1118 | gnl\|Fabrus\|A30__IGKJ1*01 | 814 | 1419 |
| 307 | gnl\|Fabrus\|VH4-34__IGHD1-7*01__IGHJ4*01 | 749 | 1354 | gnl\|Fabrus\|A30__IGKJ1*01 | 814 | 1419 |
| 308 | gnl\|Fabrus\|VH4-34__IGHD2-2*01__IGHJ4*01 | 750 | 1355 | gnl\|Fabrus\|A30__IGKJ1*01 | 814 | 1419 |
| 309 | gnl\|Fabrus\|VH4-34__IGHD3-16*01__IGHJ4*01 | 751 | 1356 | gnl\|Fabrus\|A30__IGKJ1*01 | 814 | 1419 |
| 310 | gnl\|Fabrus\|VH4-34__IGHD4-17*01__IGHJ4*01 | 753 | 1358 | gnl\|Fabrus\|A30__IGKJ1*01 | 814 | 1419 |
| 311 | gnl\|Fabrus\|VH4-34__IGHD5-12*01__IGHJ4*01 | 754 | 1359 | gnl\|Fabrus\|A30__IGKJ1*01 | 814 | 1419 |
| 312 | gnl\|Fabrus\|VH4-34__IGHD6-13*01__IGHJ4*01 | 755 | 1360 | gnl\|Fabrus\|A30__IGKJ1*01 | 814 | 1419 |
| 313 | gnl\|Fabrus\|VH4-34__IGHD6-25*01__IGHJ6*01 | 756 | 1361 | gnl\|Fabrus\|A30__IGKJ1*01 | 814 | 1419 |
| 314 | gnl\|Fabrus\|VH4-34__IGHD7-27*01__IGHJ4*01 | 758 | 1363 | gnl\|Fabrus\|A30__IGKJ1*01 | 814 | 1419 |
| 315 | gnl\|Fabrus\|VH2-26__IGHD1-20*01__IGHJ4*01 | 521 | 1126 | gnl\|Fabrus\|A30__IGKJ1*01 | 814 | 1419 |
| 316 | gnl\|Fabrus\|VH2-26__IGHD2-2*01__IGHJ4*01 | 523 | 1128 | gnl\|Fabrus\|A30__IGKJ1*01 | 814 | 1419 |
| 317 | gnl\|Fabrus\|VH2-26__IGHD3-10*01__IGHJ4*01 | 524 | 1129 | gnl\|Fabrus\|A30__IGKJ1*01 | 814 | 1419 |
| 318 | gnl\|Fabrus\|VH2-26__IGHD4-11*01__IGHJ4*01 | 526 | 1131 | gnl\|Fabrus\|A30__IGKJ1*01 | 814 | 1419 |
| 319 | gnl\|Fabrus\|VH2-26__IGHD5-18*01__IGHJ4*01 | 528 | 1133 | gnl\|Fabrus\|A30__IGKJ1*01 | 814 | 1419 |
| 320 | gnl\|Fabrus\|VH2-26__IGHD6-13*01__IGHJ4*01 | 529 | 1134 | gnl\|Fabrus\|A30__IGKJ1*01 | 814 | 1419 |
| 321 | gnl\|Fabrus\|VH2-26__IGHD7-27*01__IGHJ4*01 | 530 | 1135 | gnl\|Fabrus\|A30__IGKJ1*01 | 814 | 1419 |
| 322 | gnl\|Fabrus\|VH5-51__IGHD1-14*01__IGHJ4*01 | 776 | 1381 | gnl\|Fabrus\|A30__IGKJ1*01 | 814 | 1419 |
| 323 | gnl\|Fabrus\|VH5-51__IGHD2-8*01__IGHJ4*01 | 778 | 1383 | gnl\|Fabrus\|A30__IGKJ1*01 | 814 | 1419 |
| 324 | gnl\|Fabrus\|VH5-51__IGHD3-3*01__IGHJ4*01 | 780 | 1385 | gnl\|Fabrus\|A30__IGKJ1*01 | 814 | 1419 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 325 | gnl\|Fabrus\|VH5-51__IGHD4-17*01__IGHJ*01 | 781 | 1386 | gnl\|Fabrus\|A30__IGKJ1*01 | 814 | 1419 |
| 326 | gnl\|Fabrus\|VH5-51__IGHD5-18*01>3__IGHJ4*01 | 782 | 1387 | gnl\|Fabrus\|A30__IGKJ1*01 | 814 | 1419 |
| 327 | gnl\|Fabrus\|VH5-51__IGHD5-18*01>1__IGHJ4*01 | 783 | 1388 | gnl\|Fabrus\|A30__IGKJ1*01 | 814 | 1419 |
| 328 | gnl\|Fabrus\|VH5-51__IGHD6-25*01__IGHJ4*01 | 784 | 1389 | gnl\|Fabrus\|A30__IGKJ1*01 | 814 | 1419 |
| 329 | gnl\|Fabrus\|VH5-51__IGHD7-27*01__IGHJ4*01 | 785 | 1390 | gnl\|Fabrus\|A30__IGKJ1*01 | 814 | 1419 |
| 330 | gnl\|Fabrus\|VH6-1__IGHD1-1*01__IGHJ4*01 | 786 | 1391 | gnl\|Fabrus\|A30__IGKJ1*01 | 814 | 1419 |
| 331 | gnl\|Fabrus\|VH6-1__IGHD2-15*01__IGHJ4*01 | 788 | 1393 | gnl\|Fabrus\|A30__IGKJ1*01 | 814 | 1419 |
| 332 | gnl\|Fabrus\|VH6-1__IGHD3-3*01__IGHJ4*01 | 791 | 1396 | gnl\|Fabrus\|A30__IGKJ1*01 | 814 | 1419 |
| 333 | gnl\|Fabrus\|VH6-1__IGHD4-23*01__IGHJ4*01 | 793 | 1398 | gnl\|Fabrus\|A30__IGKJ1*01 | 814 | 1419 |
| 334 | gnl\|Fabrus\|VH6-1__IGHD4-11*01__IGHJ6*01 | 792 | 1397 | gnl\|Fabrus\|A30__IGKJ1*01 | 814 | 1419 |
| 335 | gnl\|Fabrus\|VH6-1__IGHD5-5*01__IGHJ4*01 | 794 | 1399 | gnl\|Fabrus\|A30__IGKJ1*01 | 814 | 1419 |
| 336 | gnl\|Fabrus\|VH6-1__IGHD6-13*01__IGHJ4*01 | 795 | 1400 | gnl\|Fabrus\|A30__IGKJ1*01 | 814 | 1419 |
| 337 | gnl\|Fabrus\|VH6-1__IGHD6-25*01__IGHJ6*01 | 796 | 1401 | gnl\|Fabrus\|A30__IGKJ1*01 | 814 | 1419 |
| 338 | gnl\|Fabrus\|VH6-1__IGHD7-27*01__IGHJ4*01 | 797 | 1402 | gnl\|Fabrus\|A30__IGKJ1*01 | 814 | 1419 |
| 339 | gnl\|Fabrus\|VH4-59__IGHD6-25*01__IGHJ3*01 | 775 | 1380 | gnl\|Fabrus\|A30__IGKJ1*01 | 814 | 1419 |
| 340 | gnl\|Fabrus\|VH3-48__IGHD6-6*01__IGHJ1*01 | 655 | 1260 | gnl\|Fabrus\|A30__IGKJ1*01 | 814 | 1419 |
| 341 | gnl\|Fabrus\|VH3-30__IGHD6-6*01__IGHJ1*01 | 625 | 1230 | gnl\|Fabrus\|A30__IGKJ1*01 | 814 | 1419 |
| 342 | gnl\|Fabrus\|VH3-66__IGHD6-6*01__IGHJ1*01 | 681 | 1286 | gnl\|Fabrus\|A30__IGKJ1*01 | 814 | 1419 |
| 343 | gnl\|Fabrus\|VH3-53__IGHD5-5*01__IGHJ4*01 | 670 | 1275 | gnl\|Fabrus\|A30__IGKJ1*01 | 814 | 1419 |
| 344 | gnl\|Fabrus\|VH2-5__IGHD5-12*01__IGHJ4*01 | 536 | 1141 | gnl\|Fabrus\|A30__IGKJ1*01 | 814 | 1419 |
| 345 | gnl\|Fabrus\|VH2-70__IGHD5-12*01__IGHJ4*01 | 543 | 1148 | gnl\|Fabrus\|A30__IGKJ1*01 | 814 | 1419 |
| 346 | gnl\|Fabrus\|VH3-15__IGHD5-12*01__IGHJ4*01 | 567 | 1172 | gnl\|Fabrus\|A30__IGKJ1*01 | 814 | 1419 |
| 347 | gnl\|Fabrus\|VH3-15__IGHD3-10*01__IGHJ4*01 | 565 | 1170 | gnl\|Fabrus\|A30__IGKJ1*01 | 814 | 1419 |
| 348 | gnl\|Fabrus\|VH3-49__IGHD5-18*01__IGHJ4*01 | 662 | 1267 | gnl\|Fabrus\|A30__IGKJ1*01 | 814 | 1419 |
| 349 | gnl\|Fabrus\|VH3-49__IGHD6-13*01__IGHJ4*01 | 663 | 1268 | gnl\|Fabrus\|A30__IGKJ1*01 | 814 | 1419 |
| 350 | gnl\|Fabrus\|VH3-72__IGHD5-18*01__IGHJ4*01 | 699 | 1304 | gnl\|Fabrus\|A30__IGKJ1*01 | 814 | 1419 |
| 351 | gnl\|Fabrus\|VH3-72__IGHD6-6*01__IGHJ1*01 | 701 | 1306 | gnl\|Fabrus\|A30__IGKJ1*01 | 814 | 1419 |
| 352 | gnl\|Fabrus\|VH3-73__IGHD5-12*01__IGHJ4*01 | 709 | 1314 | gnl\|Fabrus\|A30__IGKJ1*01 | 814 | 1419 |
| 353 | gnl\|Fabrus\|VH3-73__IGHD4-23*01__IGHJ5*01 | 708 | 1313 | gnl\|Fabrus\|A30__IGKJ1*01 | 814 | 1419 |
| 354 | gnl\|Fabrus\|VH3-43__IGHD3-22*01__IGHJ4*01 | 650 | 1255 | gnl\|Fabrus\|A30__IGKJ1*01 | 814 | 1419 |
| 355 | gnl\|Fabrus\|VH3-43__IGHD6-13*01__IGHJ4*01 | 653 | 1258 | gnl\|Fabrus\|A30__IGKJ1*01 | 814 | 1419 |
| 356 | gnl\|Fabrus\|VH3-9__IGHD3-22*01__IGHJ4*01 | 724 | 1329 | gnl\|Fabrus\|A30__IGKJ1*01 | 814 | 1419 |
| 357 | gnl\|Fabrus\|VH3-9__IGHD1-7*01__IGHJ5*01 | 721 | 1326 | gnl\|Fabrus\|A30__IGKJ1*01 | 814 | 1419 |
| 358 | gnl\|Fabrus\|VH3-9__IGHD6-13*01__IGHJ4*01 | 727 | 1332 | gnl\|Fabrus\|A30__IGKJ1*01 | 814 | 1419 |
| 359 | gnl\|Fabrus\|VH4-39__IGHD3-10*01__IGHJ4*01 | 762 | 1367 | gnl\|Fabrus\|A30__IGKJ1*01 | 814 | 1419 |
| 360 | gnl\|Fabrus\|VH4-39__IGHD5-12*01__IGHJ4*01 | 766 | 1371 | gnl\|Fabrus\|A30__IGKJ1*01 | 814 | 1419 |
| 361 | gnl\|Fabrus\|VH1-18__IGHD6-6*01__IGHJ1*01 | 460 | 1065 | gnl\|Fabrus\|A30__IGKJ1*01 | 814 | 1419 |
| 362 | gnl\|Fabrus\|VH1-24__IGHD5-12*01__IGHJ4*01 | 467 | 1072 | gnl\|Fabrus\|A30__IGKJ1*01 | 814 | 1419 |
| 363 | gnl\|Fabrus\|VH1-2__IGHD1-1*01__IGHJ3*01 | 461 | 1066 | gnl\|Fabrus\|A30__IGKJ1*01 | 814 | 1419 |
| 364 | gnl\|Fabrus\|VH1-3__IGHD6-6*01__IGHJ1*01 | 475 | 1080 | gnl\|Fabrus\|A30__IGKJ1*01 | 814 | 1419 |
| 365 | gnl\|Fabrus\|VH1-45__IGHD3-10*01__IGHJ4*01 | 480 | 1085 | gnl\|Fabrus\|A30__IGKJ1*01 | 814 | 1419 |
| 366 | gnl\|Fabrus\|VH1-46__IGHD1-26*01__IGHJ4*01 | 486 | 1091 | gnl\|Fabrus\|A30__IGKJ1*01 | 814 | 1419 |
| 367 | gnl\|Fabrus\|VH7-81__IGHD2-21*01__IGHJ6*01 | 800 | 1405 | gnl\|Fabrus\|A30__IGKJ1*01 | 814 | 1419 |
| 368 | gnl\|Fabrus\|VH2-70__IGHD3-9*01__IGHJ6*01 | 542 | 1147 | gnl\|Fabrus\|A30__IGKJ1*01 | 814 | 1419 |
| 369 | gnl\|Fabrus\|VH1-58__IGHD3-10*01__IGHJ6*01 | 496 | 1101 | gnl\|Fabrus\|A30__IGKJ1*01 | 814 | 1419 |
| 370 | gnl\|Fabrus\|VH7-81__IGHD2-21*01__IGHJ2*01 | 799 | 1404 | gnl\|Fabrus\|A30__IGKJ1*01 | 814 | 1419 |
| 371 | gnl\|Fabrus\|VH4-28__IGHD3-9*01__IGHJ6*01 | 734 | 1339 | gnl\|Fabrus\|A30__IGKJ1*01 | 814 | 1419 |
| 372 | gnl\|Fabrus\|VH4-31__IGHD2-15*01__IGHJ2*01 | 740 | 1345 | gnl\|Fabrus\|A30__IGKJ1*01 | 814 | 1419 |
| 373 | gnl\|Fabrus\|VH2-5__IGHD3-9*01__IGHJ6*01 | 535 | 1140 | gnl\|Fabrus\|A30__IGKJ1*01 | 814 | 1419 |
| 374 | gnl\|Fabrus\|VH1-8__IGHD2-15*01__IGHJ6*01 | 515 | 1120 | gnl\|Fabrus\|A30__IGKJ1*01 | 814 | 1419 |
| 375 | gnl\|Fabrus\|VH2-70__IGHD2-15*01__IGHJ2*01 | 540 | 1145 | gnl\|Fabrus\|A30__IGKJ1*01 | 814 | 1419 |
| 376 | gnl\|Fabrus\|VH3-38__IGHD3-10*01__IGHJ4*01 | 639 | 1244 | gnl\|Fabrus\|A30__IGKJ1*01 | 814 | 1419 |
| 377 | gnl\|Fabrus\|VH3-16__IGHD1-7*01__IGHJ6*01 | 570 | 1175 | gnl\|Fabrus\|A30__IGKJ1*01 | 814 | 1419 |
| 378 | gnl\|Fabrus\|VH3-73__IGHD3-9*01__IGHJ6*01 | 706 | 1311 | gnl\|Fabrus\|A30__IGKJ1*01 | 814 | 1419 |
| 379 | gnl\|Fabrus\|VH3-11__IGHD3-9*01__IGHJ6*01 | 548 | 1153 | gnl\|Fabrus\|A30__IGKJ1*01 | 814 | 1419 |
| 380 | gnl\|Fabrus\|VH3-11__IGHD6-6*01__IGHJ1*01 | 552 | 1157 | gnl\|Fabrus\|A30__IGKJ1*01 | 814 | 1419 |
| 381 | gnl\|Fabrus\|VH3-20__IGHD5-12*01__IGHJ4*01 | 584 | 1189 | gnl\|Fabrus\|A30__IGKJ1*01 | 814 | 1419 |
| 382 | gnl\|Fabrus\|VH3-16__IGHD2-15*01__IGHJ2*01 | 571 | 1176 | gnl\|Fabrus\|A30__IGKJ1*01 | 814 | 1419 |
| 383 | gnl\|Fabrus\|VH3-7__IGHD6-6*01__IGHJ1*01 | 692 | 1297 | gnl\|Fabrus\|A30__IGKJ1*01 | 814 | 1419 |
| 384 | gnl\|Fabrus\|VH3-16__IGHD6-13*01__IGHJ4*01 | 576 | 1181 | gnl\|Fabrus\|A30__IGKJ1*01 | 814 | 1419 |
| 385 | gnl\|Fabrus\|VH3-23__IGHD1-1*01__IGHJ4*01 | 595 | 1200 | gnl\|Fabrus\|L4/18a__IGKJ1*01 | 827 | 1432 |
| 386 | gnl\|Fabrus\|VH3-23__IGHD2-15*01__IGHJ4*01 | 598 | 1203 | gnl\|Fabrus\|L4/18a__IGKJ1*01 | 827 | 1432 |
| 387 | gnl\|Fabrus\|VH3-23__IGHD3-22*01__IGHJ4*01 | 602 | 1207 | gnl\|Fabrus\|L4/18a__IGKJ1*01 | 827 | 1432 |
| 388 | gnl\|Fabrus\|VH3-23__IGHD4-11*01__IGHJ4*01 | 604 | 1209 | gnl\|Fabrus\|L4/18a__IGKJ1*01 | 827 | 1432 |
| 389 | gnl\|Fabrus\|VH3-23__IGHD5-12*01__IGHJ4*01 | 606 | 1211 | gnl\|Fabrus\|L4/18a__IGKJ1*01 | 827 | 1432 |
| 390 | gnl\|Fabrus\|VH3-23__IGHD5-5*01__IGHJ4*01 | 608 | 1213 | gnl\|Fabrus\|L4/18a__IGKJ1*01 | 827 | 1432 |
| 391 | gnl\|Fabrus\|VH3-23__IGHD6-13*01__IGHJ4*01 | 609 | 1214 | gnl\|Fabrus\|L4/18a__IGKJ1*01 | 827 | 1432 |
| 392 | gnl\|Fabrus\|VH3-23__IGHD7-27*01__IGHJ4*01 | 612 | 1217 | gnl\|Fabrus\|L4/18a__IGKJ1*01 | 827 | 1432 |
| 393 | gnl\|Fabrus\|VH3-23__IGHD7-27*01__IGHJ6*01 | 613 | 1218 | gnl\|Fabrus\|L4/18a__IGKJ1*01 | 827 | 1432 |
| 394 | gnl\|Fabrus\|VH1-69__IGHD1-14*01__IGHJ4*01 | 502 | 1107 | gnl\|Fabrus\|L4/18a__IGKJ1*01 | 827 | 1432 |
| 395 | gnl\|Fabrus\|VH1-69__IGHD2-2*01__IGHJ4*01 | 503 | 1108 | gnl\|Fabrus\|L4/18a__IGKJ1*01 | 827 | 1432 |
| 396 | gnl\|Fabrus\|VH1-69__IGHD2-8*01__IGHJ6*01 | 504 | 1109 | gnl\|Fabrus\|L4/18a__IGKJ1*01 | 827 | 1432 |
| 397 | gnl\|Fabrus\|VH1-69__IGHD3-16*01__IGHJ4*01 | 505 | 1110 | gnl\|Fabrus\|L4/18a__IGKJ1*01 | 827 | 1432 |
| 398 | gnl\|Fabrus\|VH1-69__IGHD3-3*01__IGHJ4*01 | 506 | 1111 | gnl\|Fabrus\|L4/18a__IGKJ1*01 | 827 | 1432 |
| 399 | gnl\|Fabrus\|VH1-69__IGHD4-17*01__IGHJ4*01 | 508 | 1113 | gnl\|Fabrus\|L4/18a__IGKJ1*01 | 827 | 1432 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 400 | gnl|Fabrus|VH1-69__IGHD5-12*01__IGHJ4*01 | 509 | 1114 | gnl|Fabrus|L4/18a_IGKJ1*01 | 827 | 1432 |
| 401 | gnl|Fabrus|VH1-69__IGHD6-19*01__IGHJ4*01 | 511 | 1116 | gnl|Fabrus|L4/18a_IGKJ1*01 | 827 | 1432 |
| 402 | gnl|Fabrus|VH1-69__IGHD7-27*01__IGHJ4*01 | 513 | 1118 | gnl|Fabrus|L4/18a_IGKJ1*01 | 827 | 1432 |
| 403 | gnl|Fabrus|VH4-34__IGHD1-7*01__IGHJ4*01 | 749 | 1354 | gnl|Fabrus|L4/18a_IGKJ1*01 | 827 | 1432 |
| 404 | gnl|Fabrus|VH4-34__IGHD2-2*01__IGHJ4*01 | 750 | 1355 | gnl|Fabrus|L4/18a_IGKJ1*01 | 827 | 1432 |
| 405 | gnl|Fabrus|VH4-34__IGHD3-16*01__IGHJ4*01 | 751 | 1356 | gnl|Fabrus|L4/18a_IGKJ1*01 | 827 | 1432 |
| 406 | gnl|Fabrus|VH4-34__IGHD4-17*01__IGHJ4*01 | 753 | 1358 | gnl|Fabrus|L4/18a_IGKJ1*01 | 827 | 1432 |
| 407 | gnl|Fabrus|VH4-34__IGHD5-12*01__IGHJ4*01 | 754 | 1359 | gnl|Fabrus|L4/18a_IGKJ1*01 | 827 | 1432 |
| 408 | gnl|Fabrus|VH4-34__IGHD6-13*01__IGHJ4*01 | 755 | 1360 | gnl|Fabrus|L4/18a_IGKJ1*01 | 827 | 1432 |
| 409 | gnl|Fabrus|VH4-34__IGHD6-25*01__IGHJ6*01 | 756 | 1361 | gnl|Fabrus|L4/18a_IGKJ1*01 | 827 | 1432 |
| 410 | gnl|Fabrus|VH4-34__IGHD7-27*01__IGHJ4*01 | 758 | 1363 | gnl|Fabrus|L4/18a_IGKJ1*01 | 827 | 1432 |
| 411 | gnl|Fabrus|VH2-26__IGHD1-20*01__IGHJ4*01 | 521 | 1126 | gnl|Fabrus|L4/18a_IGKJ1*01 | 827 | 1432 |
| 412 | gnl|Fabrus|VH2-26__IGHD2-2*01__IGHJ4*01 | 523 | 1128 | gnl|Fabrus|L4/18a_IGKJ1*01 | 827 | 1432 |
| 413 | gnl|Fabrus|VH2-26__IGHD3-10*01__IGHJ4*01 | 524 | 1129 | gnl|Fabrus|L4/18a_IGKJ1*01 | 827 | 1432 |
| 414 | gnl|Fabrus|VH2-26__IGHD4-11*01__IGHJ4*01 | 526 | 1131 | gnl|Fabrus|L4/18a_IGKJ1*01 | 827 | 1432 |
| 415 | gnl|Fabrus|VH2-26__IGHD5-18*01__IGHJ4*01 | 528 | 1133 | gnl|Fabrus|L4/18a_IGKJ1*01 | 827 | 1432 |
| 416 | gnl|Fabrus|VH2-26__IGHD6-13*01__IGHJ4*01 | 529 | 1134 | gnl|Fabrus|L4/18a_IGKJ1*01 | 827 | 1432 |
| 417 | gnl|Fabrus|VH2-26__IGHD7-27*01__IGHJ4*01 | 530 | 1135 | gnl|Fabrus|L4/18a_IGKJ1*01 | 827 | 1432 |
| 418 | gnl|Fabrus|VH5-51__IGHD1-14*01__IGHJ4*01 | 776 | 1381 | gnl|Fabrus|L4/18a_IGKJ1*01 | 827 | 1432 |
| 419 | gnl|Fabrus|VH5-51__IGHD2-8*01__IGHJ4*01 | 778 | 1383 | gnl|Fabrus|L4/18a_IGKJ1*01 | 827 | 1432 |
| 420 | gnl|Fabrus|VH5-51__IGHD3-3*01__IGHJ4*01 | 780 | 1385 | gnl|Fabrus|L4/18a_IGKJ1*01 | 827 | 1432 |
| 421 | gnl|Fabrus|VH5-51__IGHD4-17*01__IGHJ4*01 | 781 | 1386 | gnl|Fabrus|L4/18a_IGKJ1*01 | 827 | 1432 |
| 422 | gnl|Fabrus|VH5-51__IGHD5-18*01>3__IGHJ4*01 | 782 | 1387 | gnl|Fabrus|L4/18a_IGKJ1*01 | 827 | 1432 |
| 423 | gnl|Fabrus|VH5-51__IGHD5-18*01>1__IGHJ4*01 | 783 | 1388 | gnl|Fabrus|L4/18a_IGKJ1*01 | 827 | 1432 |
| 424 | gnl|Fabrus|VH5-51__IGHD6-25*01__IGHJ4*01 | 784 | 1389 | gnl|Fabrus|L4/18a_IGKJ1*01 | 827 | 1432 |
| 425 | gnl|Fabrus|VH5-51__IGHD7-27*01__IGHJ4*01 | 785 | 1390 | gnl|Fabrus|L4/18a_IGKJ1*01 | 827 | 1432 |
| 426 | gnl|Fabrus|VH6-1__IGHD1-1*01__IGHJ4*01 | 786 | 1391 | gnl|Fabrus|L4/18a_IGKJ1*01 | 827 | 1432 |
| 427 | gnl|Fabrus|VH6-1__IGHD2-15*01__IGHJ4*01 | 788 | 1393 | gnl|Fabrus|L4/18a_IGKJ1*01 | 827 | 1432 |
| 428 | gnl|Fabrus|VH6-1__IGHD3-3*01__IGHJ4*01 | 791 | 1396 | gnl|Fabrus|L4/18a_IGKJ1*01 | 827 | 1432 |
| 429 | gnl|Fabrus|VH6-1__IGHD4-23*01__IGHJ4*01 | 793 | 1398 | gnl|Fabrus|L4/18a_IGKJ1*01 | 827 | 1432 |
| 430 | gnl|Fabrus|VH6-1__IGHD4-11*01__IGHJ6*01 | 792 | 1397 | gnl|Fabrus|L4/18a_IGKJ1*01 | 827 | 1432 |
| 431 | gnl|Fabrus|VH6-1__IGHD5-5*01__IGHJ4*01 | 794 | 1399 | gnl|Fabrus|L4/18a_IGKJ1*01 | 827 | 1432 |
| 432 | gnl|Fabrus|VH6-1__IGHD6-13*01__IGHJ4*01 | 795 | 1400 | gnl|Fabrus|L4/18a_IGKJ1*01 | 827 | 1432 |
| 433 | gnl|Fabrus|VH6-1__IGHD6-25*01__IGHJ6*01 | 796 | 1401 | gnl|Fabrus|L4/18a_IGKJ1*01 | 827 | 1432 |
| 434 | gnl|Fabrus|VH6-1__IGHD7-27*01__IGHJ4*01 | 797 | 1402 | gnl|Fabrus|L4/18a_IGKJ1*01 | 827 | 1432 |
| 435 | gnl|Fabrus|VH4-59__IGHD6-25*01__IGHJ3*01 | 775 | 1380 | gnl|Fabrus|L4/18a_IGKJ1*01 | 827 | 1432 |
| 436 | gnl|Fabrus|VH3-48__IGHD6-6*01__IGHJ1*01 | 655 | 1260 | gnl|Fabrus|L4/18a_IGKJ1*01 | 827 | 1432 |
| 437 | gnl|Fabrus|VH3-30__IGHD6-6*01__IGHJ1*01 | 625 | 1230 | gnl|Fabrus|L4/18a_IGKJ1*01 | 827 | 1432 |
| 438 | gnl|Fabrus|VH3-66__IGHD6-6*01__IGHJ1*01 | 681 | 1286 | gnl|Fabrus|L4/18a_IGKJ1*01 | 827 | 1432 |
| 439 | gnl|Fabrus|VH3-53__IGHD5-5*01__IGHJ4*01 | 670 | 1275 | gnl|Fabrus|L4/18a_IGKJ1*01 | 827 | 1432 |
| 440 | gnl|Fabrus|VH2-5__IGHD5-12*01__IGHJ4*01 | 536 | 1141 | gnl|Fabrus|L4/18a_IGKJ1*01 | 827 | 1432 |
| 441 | gnl|Fabrus|VH2-70__IGHD5-12*01__IGHJ4*01 | 543 | 1148 | gnl|Fabrus|L4/18a_IGKJ1*01 | 827 | 1432 |
| 442 | gnl|Fabrus|VH3-15__IGHD5-12*01__IGHJ4*01 | 567 | 1172 | gnl|Fabrus|L4/18a_IGKJ1*01 | 827 | 1432 |
| 443 | gnl|Fabrus|VH3-15__IGHD3-10*01__IGHJ4*01 | 565 | 1170 | gnl|Fabrus|L4/18a_IGKJ1*01 | 827 | 1432 |
| 444 | gnl|Fabrus|VH3-49__IGHD5-18*01__IGHJ4*01 | 662 | 1267 | gnl|Fabrus|L4/18a_IGKJ1*01 | 827 | 1432 |
| 445 | gnl|Fabrus|VH3-49__IGHD6-13*01__IGHJ4*01 | 663 | 1268 | gnl|Fabrus|L4/18a_IGKJ1*01 | 827 | 1432 |
| 446 | gnl|Fabrus|VH3-72__IGHD5-18*01__IGHJ4*01 | 699 | 1304 | gnl|Fabrus|L4/18a_IGKJ1*01 | 827 | 1432 |
| 447 | gnl|Fabrus|VH3-72__IGHD6-6*01__IGHJ1*01 | 701 | 1306 | gnl|Fabrus|L4/18a_IGKJ1*01 | 827 | 1432 |
| 448 | gnl|Fabrus|VH3-73__IGHD5-12*01__IGHJ4*01 | 709 | 1314 | gnl|Fabrus|L4/18a_IGKJ1*01 | 827 | 1432 |
| 449 | gnl|Fabrus|VH3-73__IGHD4-23*01__IGHJ5*01 | 708 | 1313 | gnl|Fabrus|L4/18a_IGKJ1*01 | 827 | 1432 |
| 450 | gnl|Fabrus|VH3-43__IGHD3-22*01__IGHJ4*01 | 650 | 1255 | gnl|Fabrus|L4/18a_IGKJ1*01 | 827 | 1432 |
| 451 | gnl|Fabrus|VH3-43__IGHD6-13*01__IGHJ4*01 | 653 | 1258 | gnl|Fabrus|L4/18a_IGKJ1*01 | 827 | 1432 |
| 452 | gnl|Fabrus|VH3-9__IGHD3-22*01__IGHJ4*01 | 724 | 1329 | gnl|Fabrus|L4/18a_IGKJ1*01 | 827 | 1432 |
| 453 | gnl|Fabrus|VH3-9__IGHD1-7*01__IGHJ5*01 | 721 | 1326 | gnl|Fabrus|L4/18a_IGKJ1*01 | 827 | 1432 |
| 454 | gnl|Fabrus|VH3-9__IGHD6-13*01__IGHJ4*01 | 727 | 1332 | gnl|Fabrus|L4/18a_IGKJ1*01 | 827 | 1432 |
| 455 | gnl|Fabrus|VH4-39__IGHD3-10*01__IGHJ4*01 | 762 | 1367 | gnl|Fabrus|L4/18a_IGKJ1*01 | 827 | 1432 |
| 456 | gnl|Fabrus|VH4-39__IGHD5-12*01__IGHJ4*01 | 766 | 1371 | gnl|Fabrus|L4/18a_IGKJ1*01 | 827 | 1432 |
| 457 | gnl|Fabrus|VH1-18__IGHD6-6*01__IGHJ1*01 | 460 | 1065 | gnl|Fabrus|L4/18a_IGKJ1*01 | 827 | 1432 |
| 458 | gnl|Fabrus|VH1-24__IGHD5-12*01__IGHJ4*01 | 467 | 1072 | gnl|Fabrus|L4/18a_IGKJ1*01 | 827 | 1432 |
| 459 | gnl|Fabrus|VH1-2__IGHD1-1*01__IGHJ3*01 | 461 | 1066 | gnl|Fabrus|L4/18a_IGKJ1*01 | 827 | 1432 |
| 460 | gnl|Fabrus|VH1-3__IGHD6-6*01__IGHJ1*01 | 475 | 1080 | gnl|Fabrus|L4/18a_IGKJ1*01 | 827 | 1432 |
| 461 | gnl|Fabrus|VH1-45__IGHD3-10*01__IGHJ4*01 | 480 | 1085 | gnl|Fabrus|L4/18a_IGKJ1*01 | 827 | 1432 |
| 462 | gnl|Fabrus|VH1-46__IGHD1-26*01__IGHJ4*01 | 486 | 1091 | gnl|Fabrus|L4/18a_IGKJ1*01 | 827 | 1432 |
| 463 | gnl|Fabrus|VH7-81__IGHD2-21*01__IGHJ6*01 | 800 | 1405 | gnl|Fabrus|L4/18a_IGKJ1*01 | 827 | 1432 |
| 464 | gnl|Fabrus|VH2-70__IGHD3-9*01__IGHJ6*01 | 542 | 1147 | gnl|Fabrus|L4/18a_IGKJ1*01 | 827 | 1432 |
| 465 | gnl|Fabrus|VH1-58__IGHD3-10*01__IGHJ6*01 | 496 | 1101 | gnl|Fabrus|L4/18a_IGKJ1*01 | 827 | 1432 |
| 466 | gnl|Fabrus|VH7-81__IGHD2-21*01__IGHJ2*01 | 799 | 1404 | gnl|Fabrus|L4/18a_IGKJ1*01 | 827 | 1432 |
| 467 | gnl|Fabrus|VH4-28__IGHD3-9*01__IGHJ6*01 | 734 | 1339 | gnl|Fabrus|L4/18a_IGKJ1*01 | 827 | 1432 |
| 468 | gnl|Fabrus|VH4-31__IGHD2-15*01__IGHJ2*01 | 740 | 1345 | gnl|Fabrus|L4/18a_IGKJ1*01 | 827 | 1432 |
| 469 | gnl|Fabrus|VH2-5__IGHD3-9*01__IGHJ6*01 | 535 | 1140 | gnl|Fabrus|L4/18a_IGKJ1*01 | 827 | 1432 |
| 470 | gnl|Fabrus|VH1-8__IGHD2-15*01__IGHJ6*01 | 515 | 1120 | gnl|Fabrus|L4/18a_IGKJ1*01 | 827 | 1432 |
| 471 | gnl|Fabrus|VH2-70__IGHD2-15*01__IGHJ2*01 | 540 | 1145 | gnl|Fabrus|L4/18a_IGKJ1*01 | 827 | 1432 |
| 472 | gnl|Fabrus|VH3-38__IGHD3-10*01__IGHJ4*01 | 639 | 1244 | gnl|Fabrus|L4/18a_IGKJ1*01 | 827 | 1432 |
| 473 | gnl|Fabrus|VH3-16__IGHD1-7*01__IGHJ6*01 | 570 | 1175 | gnl|Fabrus|L4/18a_IGKJ1*01 | 827 | 1432 |
| 474 | gnl|Fabrus|VH3-73__IGHD3-9*01__IGHJ6*01 | 706 | 1311 | gnl|Fabrus|L4/18a_IGKJ1*01 | 827 | 1432 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 475 | gnl\|Fabrus\|VH3-11__IGHD3-9*01__IGHJ6*01 | 548 | 1153 | gnl\|Fabrus\|L4/18a_IGKJ1*01 | 827 | 1432 |
| 476 | gnl\|Fabrus\|VH3-11__IGHD6-6*01__IGHJ1*01 | 552 | 1157 | gnl\|Fabrus\|L4/18a_IGKJ1*01 | 827 | 1432 |
| 477 | gnl\|Fabrus\|VH3-20__IGHD5-12*01__IGHJ4*01 | 584 | 1189 | gnl\|Fabrus\|L4/18a_IGKJ1*01 | 827 | 1432 |
| 478 | gnl\|Fabrus\|VH3-16__IGHD2-15*01__IGHJ2*01 | 571 | 1176 | gnl\|Fabrus\|L4/18a_IGKJ1*01 | 827 | 1432 |
| 479 | gnl\|Fabrus\|VH3-7__IGHD6-6*01__IGHJ1*01 | 692 | 1297 | gnl\|Fabrus\|L4/18a_IGKJ1*01 | 827 | 1432 |
| 480 | gnl\|Fabrus\|VH3-16__IGHD6-13*01__IGHJ4*01 | 576 | 1181 | gnl\|Fabrus\|L4/18a_IGKJ1*01 | 827 | 1432 |
| 481 | gnl\|Fabrus\|VH3-23__IGHD1-1*01__IGHJ4*01 | 595 | 1200 | gnl\|Fabrus\|L5_IGKJ1*01 | 828 | 1433 |
| 482 | gnl\|Fabrus\|VH3-23__IGHD2-15*01__IGHJ4*01 | 598 | 1203 | gnl\|Fabrus\|L5_IGKJ1*01 | 828 | 1433 |
| 483 | gnl\|Fabrus\|VH3-23__IGHD3-22*01__IGHJ4*01 | 602 | 1207 | gnl\|Fabrus\|L5_IGKJ1*01 | 828 | 1433 |
| 484 | gnl\|Fabrus\|VH3-23__IGHD4-11*01__IGHJ4*01 | 604 | 1209 | gnl\|Fabrus\|L5_IGKJ1*01 | 828 | 1433 |
| 485 | gnl\|Fabrus\|VH3-23__IGHD5-12*01__IGHJ4*01 | 606 | 1211 | gnl\|Fabrus\|L5_IGKJ1*01 | 828 | 1433 |
| 486 | gnl\|Fabrus\|VH3-23__IGHD5-5*01__IGHJ4*01 | 608 | 1213 | gnl\|Fabrus\|L5_IGKJ1*01 | 828 | 1433 |
| 487 | gnl\|Fabrus\|VH3-23__IGHD6-13*01__IGHJ4*01 | 609 | 1214 | gnl\|Fabrus\|L5_IGKJ1*01 | 828 | 1433 |
| 488 | gnl\|Fabrus\|VH3-23__IGHD7-27*01__IGHJ4*01 | 612 | 1217 | gnl\|Fabrus\|L5_IGKJ1*01 | 828 | 1433 |
| 489 | gnl\|Fabrus\|VH3-23__IGHD7-27*01__IGHJ6*01 | 613 | 1218 | gnl\|Fabrus\|L5_IGKJ1*01 | 828 | 1433 |
| 490 | gnl\|Fabrus\|VH1-69__IGHD1-14*01__IGHJ4*01 | 502 | 1107 | gnl\|Fabrus\|L5_IGKJ1*01 | 828 | 1433 |
| 491 | gnl\|Fabrus\|VH1-69__IGHD2-2*01__IGHJ4*01 | 503 | 1108 | gnl\|Fabrus\|L5_IGKJ1*01 | 828 | 1433 |
| 492 | gnl\|Fabrus\|VH1-69__IGHD2-8*01__IGHJ6*01 | 504 | 1109 | gnl\|Fabrus\|L5_IGKJ1*01 | 828 | 1433 |
| 493 | gnl\|Fabrus\|VH1-69__IGHD3-16*01__IGHJ4*01 | 505 | 1110 | gnl\|Fabrus\|L5_IGKJ1*01 | 828 | 1433 |
| 494 | gnl\|Fabrus\|VH1-69__IGHD3-3*01__IGHJ4*01 | 506 | 1111 | gnl\|Fabrus\|L5_IGKJ1*01 | 828 | 1433 |
| 495 | gnl\|Fabrus\|VH1-69__IGHD4-17*01__IGHJ4*01 | 508 | 1113 | gnl\|Fabrus\|L5_IGKJ1*01 | 828 | 1433 |
| 496 | gnl\|Fabrus\|VH1-69__IGHD5-12*01__IGHJ4*01 | 509 | 1114 | gnl\|Fabrus\|L5_IGKJ1*01 | 828 | 1433 |
| 497 | gnl\|Fabrus\|VH1-69__IGHD6-19*01__IGHJ4*01 | 511 | 1116 | gnl\|Fabrus\|L5_IGKJ1*01 | 828 | 1433 |
| 498 | gnl\|Fabrus\|VH1-69__IGHD7-27*01__IGHJ4*01 | 513 | 1118 | gnl\|Fabrus\|L5_IGKJ1*01 | 828 | 1433 |
| 499 | gnl\|Fabrus\|VH4-34__IGHD1-7*01__IGHJ4*01 | 749 | 1354 | gnl\|Fabrus\|L5_IGKJ1*01 | 828 | 1433 |
| 500 | gnl\|Fabrus\|VH4-34__IGHD2-2*01__IGHJ4*01 | 750 | 1355 | gnl\|Fabrus\|L5_IGKJ1*01 | 828 | 1433 |
| 501 | gnl\|Fabrus\|VH4-34__IGHD3-16*01__IGHJ4*01 | 751 | 1356 | gnl\|Fabrus\|L5_IGKJ1*01 | 828 | 1433 |
| 502 | gnl\|Fabrus\|VH4-34__IGHD4-17*01__IGHJ4*01 | 753 | 1358 | gnl\|Fabrus\|L5_IGKJ1*01 | 828 | 1433 |
| 503 | gnl\|Fabrus\|VH4-34__IGHD5-12*01__IGHJ4*01 | 754 | 1359 | gnl\|Fabrus\|L5_IGKJ1*01 | 828 | 1433 |
| 504 | gnl\|Fabrus\|VH4-34__IGHD6-13*01__IGHJ4*01 | 755 | 1360 | gnl\|Fabrus\|L5_IGKJ1*01 | 828 | 1433 |
| 505 | gnl\|Fabrus\|VH4-34__IGHD6-25*01__IGHJ6*01 | 756 | 1361 | gnl\|Fabrus\|L5_IGKJ1*01 | 828 | 1433 |
| 506 | gnl\|Fabrus\|VH4-34__IGHD7-27*01__IGHJ4*01 | 758 | 1363 | gnl\|Fabrus\|L5_IGKJ1*01 | 828 | 1433 |
| 507 | gnl\|Fabrus\|VH2-26__IGHD1-20*01__IGHJ4*01 | 521 | 1126 | gnl\|Fabrus\|L5_IGKJ1*01 | 828 | 1433 |
| 508 | gnl\|Fabrus\|VH2-26__IGHD2-2*01__IGHJ4*01 | 523 | 1128 | gnl\|Fabrus\|L5_IGKJ1*01 | 828 | 1433 |
| 509 | gnl\|Fabrus\|VH2-26__IGHD3-10*01__IGHJ4*01 | 524 | 1129 | gnl\|Fabrus\|L5_IGKJ1*01 | 828 | 1433 |
| 510 | gnl\|Fabrus\|VH2-26__IGHD4-11*01__IGHJ4*01 | 526 | 1131 | gnl\|Fabrus\|L5_IGKJ1*01 | 828 | 1433 |
| 511 | gnl\|Fabrus\|VH2-26__IGHD5-18*01__IGHJ4*01 | 528 | 1133 | gnl\|Fabrus\|L5_IGKJ1*01 | 828 | 1433 |
| 512 | gnl\|Fabrus\|VH2-26__IGHD6-13*01__IGHJ4*01 | 529 | 1134 | gnl\|Fabrus\|L5_IGKJ1*01 | 828 | 1433 |
| 513 | gnl\|Fabrus\|VH2-26__IGHD7-27*01__IGHJ4*01 | 530 | 1135 | gnl\|Fabrus\|L5_IGKJ1*01 | 828 | 1433 |
| 514 | gnl\|Fabrus\|VH5-51__IGHD1-14*01__IGHJ4*01 | 776 | 1381 | gnl\|Fabrus\|L5_IGKJ1*01 | 828 | 1433 |
| 515 | gnl\|Fabrus\|VH5-51__IGHD2-8*01__IGHJ4*01 | 778 | 1383 | gnl\|Fabrus\|L5_IGKJ1*01 | 828 | 1433 |
| 516 | gnl\|Fabrus\|VH5-51__IGHD3-3*01__IGHJ4*01 | 780 | 1385 | gnl\|Fabrus\|L5_IGKJ1*01 | 828 | 1433 |
| 517 | gnl\|Fabrus\|VH5-51__IGHD4-17*01__IGHJ4*01 | 781 | 1386 | gnl\|Fabrus\|L5_IGKJ1*01 | 828 | 1433 |
| 518 | gnl\|Fabrus\|VH5-51__IGHD5-18*01>3_IGHJ4*01 | 782 | 1387 | gnl\|Fabrus\|L5_IGKJ1*01 | 828 | 1433 |
| 519 | gnl\|Fabrus\|VH5-51__IGHD5-18*01>1_IGHJ4*01 | 783 | 1388 | gnl\|Fabrus\|L5_IGKJ1*01 | 828 | 1433 |
| 520 | gnl\|Fabrus\|VH5-51__IGHD6-25*01__IGHJ4*01 | 784 | 1389 | gnl\|Fabrus\|L5_IGKJ1*01 | 828 | 1433 |
| 521 | gnl\|Fabrus\|VH5-51__IGHD7-27*01__IGHJ4*01 | 785 | 1390 | gnl\|Fabrus\|L5_IGKJ1*01 | 828 | 1433 |
| 522 | gnl\|Fabrus\|VH6-1__IGHD1-1*01__IGHJ4*01 | 786 | 1391 | gnl\|Fabrus\|L5_IGKJ1*01 | 828 | 1433 |
| 523 | gnl\|Fabrus\|VH6-1__IGHD2-15*01__IGHJ4*01 | 788 | 1393 | gnl\|Fabrus\|L5_IGKJ1*01 | 828 | 1433 |
| 524 | gnl\|Fabrus\|VH6-1__IGHD3-3*01__IGHJ4*01 | 791 | 1396 | gnl\|Fabrus\|L5_IGKJ1*01 | 828 | 1433 |
| 525 | gnl\|Fabrus\|VH6-1__IGHD4-23*01__IGHJ4*01 | 793 | 1398 | gnl\|Fabrus\|L5_IGKJ1*01 | 828 | 1433 |
| 526 | gnl\|Fabrus\|VH6-1__IGHD4-11*01__IGHJ6*01 | 792 | 1397 | gnl\|Fabrus\|L5_IGKJ1*01 | 828 | 1433 |
| 527 | gnl\|Fabrus\|VH6-1__IGHD5-5*01__IGHJ4*01 | 794 | 1399 | gnl\|Fabrus\|L5_IGKJ1*01 | 828 | 1433 |
| 528 | gnl\|Fabrus\|VH6-1__IGHD6-13*01__IGHJ4*01 | 795 | 1400 | gnl\|Fabrus\|L5_IGKJ1*01 | 828 | 1433 |
| 529 | gnl\|Fabrus\|VH6-1__IGHD6-25*01__IGHJ6*01 | 796 | 1401 | gnl\|Fabrus\|L5_IGKJ1*01 | 828 | 1433 |
| 530 | gnl\|Fabrus\|VH6-1__IGHD7-27*01__IGHJ4*01 | 797 | 1402 | gnl\|Fabrus\|L5_IGKJ1*01 | 828 | 1433 |
| 531 | gnl\|Fabrus\|VH4-59__IGHD6-25*01__IGHJ3*01 | 775 | 1380 | gnl\|Fabrus\|L5_IGKJ1*01 | 828 | 1433 |
| 532 | gnl\|Fabrus\|VH3-48__IGHD6-6*01__IGHJ1*01 | 655 | 1260 | gnl\|Fabrus\|L5_IGKJ1*01 | 828 | 1433 |
| 533 | gnl\|Fabrus\|VH3-30__IGHD6-6*01__IGHJ1*01 | 625 | 1230 | gnl\|Fabrus\|L5_IGKJ1*01 | 828 | 1433 |
| 534 | gnl\|Fabrus\|VH3-66__IGHD6-6*01__IGHJ1*01 | 681 | 1286 | gnl\|Fabrus\|L5_IGKJ1*01 | 828 | 1433 |
| 535 | gnl\|Fabrus\|VH3-53__IGHD5-5*01__IGHJ4*01 | 670 | 1275 | gnl\|Fabrus\|L5_IGKJ1*01 | 828 | 1433 |
| 536 | gnl\|Fabrus\|VH2-5__IGHD5-12*01__IGHJ4*01 | 536 | 1141 | gnl\|Fabrus\|L5_IGKJ1*01 | 828 | 1433 |
| 537 | gnl\|Fabrus\|VH2-70__IGHD5-12*01__IGHJ4*01 | 543 | 1148 | gnl\|Fabrus\|L5_IGKJ1*01 | 828 | 1433 |
| 538 | gnl\|Fabrus\|VH3-15__IGHD5-12*01__IGHJ4*01 | 567 | 1172 | gnl\|Fabrus\|L5_IGKJ1*01 | 828 | 1433 |
| 539 | gnl\|Fabrus\|VH3-15__IGHD3-10*01__IGHJ4*01 | 565 | 1170 | gnl\|Fabrus\|L5_IGKJ1*01 | 828 | 1433 |
| 540 | gnl\|Fabrus\|VH3-49__IGHD5-18*01__IGHJ4*01 | 662 | 1267 | gnl\|Fabrus\|L5_IGKJ1*01 | 828 | 1433 |
| 541 | gnl\|Fabrus\|VH3-49__IGHD6-13*01__IGHJ4*01 | 663 | 1268 | gnl\|Fabrus\|L5_IGKJ1*01 | 828 | 1433 |
| 542 | gnl\|Fabrus\|VH3-72__IGHD5-18*01__IGHJ4*01 | 699 | 1304 | gnl\|Fabrus\|L5_IGKJ1*01 | 828 | 1433 |
| 543 | gnl\|Fabrus\|VH3-72__IGHD6-6*01__IGHJ1*01 | 701 | 1306 | gnl\|Fabrus\|L5_IGKJ1*01 | 828 | 1433 |
| 544 | gnl\|Fabrus\|VH3-73__IGHD5-12*01__IGHJ4*01 | 709 | 1314 | gnl\|Fabrus\|L5_IGKJ1*01 | 828 | 1433 |
| 545 | gnl\|Fabrus\|VH3-73__IGHD4-23*01__IGHJ5*01 | 708 | 1313 | gnl\|Fabrus\|L5_IGKJ1*01 | 828 | 1433 |
| 546 | gnl\|Fabrus\|VH3-43__IGHD3-22*01__IGHJ4*01 | 650 | 1255 | gnl\|Fabrus\|L5_IGKJ1*01 | 828 | 1433 |
| 547 | gnl\|Fabrus\|VH3-43__IGHD6-13*01__IGHJ4*01 | 653 | 1258 | gnl\|Fabrus\|L5_IGKJ1*01 | 828 | 1433 |
| 548 | gnl\|Fabrus\|VH3-9_IGHD3-22*01__IGHJ4*01 | 724 | 1329 | gnl\|Fabrus\|L5_IGKJ1*01 | 828 | 1433 |
| 549 | gnl\|Fabrus\|VH3-9_IGHD1-7*01__IGHJ5*01 | 721 | 1326 | gnl\|Fabrus\|L5_IGKJ1*01 | 828 | 1433 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 550 | gnl|Fabrus|VH3-9__IGHD6-13*01__IGHJ4*01 | 727 | 1332 | gnl|Fabrus|L5__IGKJ1*01 | 828 | 1433 |
| 551 | gnl|Fabrus|VH4-39__IGHD3-10*01__IGHJ4*01 | 762 | 1367 | gnl|Fabrus|L5__IGKJ1*01 | 828 | 1433 |
| 552 | gnl|Fabrus|VH4-39__IGHD5-12*01__IGHJ4*01 | 766 | 1371 | gnl|Fabrus|L5__IGKJ1*01 | 828 | 1433 |
| 553 | gnl|Fabrus|VH1-18__IGHD6-6*01__IGHJ1*01 | 460 | 1065 | gnl|Fabrus|L5__IGKJ1*01 | 828 | 1433 |
| 554 | gnl|Fabrus|VH1-24__IGHD5-12*01__IGHJ4*01 | 467 | 1072 | gnl|Fabrus|L5__IGKJ1*01 | 828 | 1433 |
| 555 | gnl|Fabrus|VH1-2__IGHD1-1*01__IGHJ3*01 | 461 | 1066 | gnl|Fabrus|L5__IGKJ1*01 | 828 | 1433 |
| 556 | gnl|Fabrus|VH1-3__IGHD6-6*01__IGHJ1*01 | 475 | 1080 | gnl|Fabrus|L5__IGKJ1*01 | 828 | 1433 |
| 557 | gnl|Fabrus|VH1-45__IGHD3-10*01__IGHJ4*01 | 480 | 1085 | gnl|Fabrus|L5__IGKJ1*01 | 828 | 1433 |
| 558 | gnl|Fabrus|VH1-46__IGHD1-26*01__IGHJ4*01 | 486 | 1091 | gnl|Fabrus|L5__IGKJ1*01 | 828 | 1433 |
| 559 | gnl|Fabrus|VH7-81__IGHD2-21*01__IGHJ6*01 | 800 | 1405 | gnl|Fabrus|L5__IGKJ1*01 | 828 | 1433 |
| 560 | gnl|Fabrus|VH2-70__IGHD3-9*01__IGHJ6*01 | 542 | 1147 | gnl|Fabrus|L5__IGKJ1*01 | 828 | 1433 |
| 561 | gnl|Fabrus|VH1-58__IGHD3-10*01__IGHJ6*01 | 496 | 1101 | gnl|Fabrus|L5__IGKJ1*01 | 828 | 1433 |
| 562 | gnl|Fabrus|VH7-81__IGHD2-21*01__IGHJ2*01 | 799 | 1404 | gnl|Fabrus|L5__IGKJ1*01 | 828 | 1433 |
| 563 | gnl|Fabrus|VH4-28__IGHD3-9*01__IGHJ6*01 | 734 | 1339 | gnl|Fabrus|L5__IGKJ1*01 | 828 | 1433 |
| 564 | gnl|Fabrus|VH4-31__IGHD2-15*01__IGHJ2*01 | 740 | 1345 | gnl|Fabrus|L5__IGKJ1*01 | 828 | 1433 |
| 565 | gnl|Fabrus|VH2-5__IGHD3-9*01__IGHJ6*01 | 535 | 1140 | gnl|Fabrus|L5__IGKJ1*01 | 828 | 1433 |
| 566 | gnl|Fabrus|VH1-8__IGHD2-15*01__IGHJ6*01 | 515 | 1120 | gnl|Fabrus|L5__IGKJ1*01 | 828 | 1433 |
| 567 | gnl|Fabrus|VH2-70__IGHD2-15*01__IGHJ2*01 | 540 | 1145 | gnl|Fabrus|L5__IGKJ1*01 | 828 | 1433 |
| 568 | gnl|Fabrus|VH3-38__IGHD3-10*01__IGHJ4*01 | 639 | 1244 | gnl|Fabrus|L5__IGKJ1*01 | 828 | 1433 |
| 569 | gnl|Fabrus|VH3-16__IGHD1-7*01__IGHJ6*01 | 570 | 1175 | gnl|Fabrus|L5__IGKJ1*01 | 828 | 1433 |
| 570 | gnl|Fabrus|VH3-73__IGHD3-9*01__IGHJ6*01 | 706 | 1311 | gnl|Fabrus|L5__IGKJ1*01 | 828 | 1433 |
| 571 | gnl|Fabrus|VH3-11__IGHD3-9*01__IGHJ6*01 | 548 | 1153 | gnl|Fabrus|L5__IGKJ1*01 | 828 | 1433 |
| 572 | gnl|Fabrus|VH3-11__IGHD6-6*01__IGHJ1*01 | 552 | 1157 | gnl|Fabrus|L5__IGKJ1*01 | 828 | 1433 |
| 573 | gnl|Fabrus|VH3-20__IGHD5-12*01__IGHJ4*01 | 584 | 1189 | gnl|Fabrus|L5__IGKJ1*01 | 828 | 1433 |
| 574 | gnl|Fabrus|VH3-16__IGHD2-15*01__IGHJ2*01 | 571 | 1176 | gnl|Fabrus|L5__IGKJ1*01 | 828 | 1433 |
| 575 | gnl|Fabrus|VH3-7__IGHD6-6*01__IGHJ1*01 | 692 | 1297 | gnl|Fabrus|L5__IGKJ1*01 | 828 | 1433 |
| 576 | gnl|Fabrus|VH3-16__IGHD6-13*01__IGHJ4*01 | 576 | 1181 | gnl|Fabrus|L5__IGKJ1*01 | 828 | 1433 |
| 577 | gnl|Fabrus|VH3-23__IGHD1-1*01__IGHJ4*01 | 595 | 1200 | gnl|Fabrus|L8__IGKJ1*01 | 830 | 1435 |
| 578 | gnl|Fabrus|VH3-23__IGHD2-15*01__IGHJ4*01 | 598 | 1203 | gnl|Fabrus|L8__IGKJ1*01 | 830 | 1435 |
| 579 | gnl|Fabrus|VH3-23__IGHD3-22*01__IGHJ4*01 | 602 | 1207 | gnl|Fabrus|L8__IGKJ1*01 | 830 | 1435 |
| 580 | gnl|Fabrus|VH3-23__IGHD4-11*01__IGHJ4*01 | 604 | 1209 | gnl|Fabrus|L8__IGKJ1*01 | 830 | 1435 |
| 581 | gnl|Fabrus|VH3-23__IGHD5-12*01__IGHJ4*01 | 606 | 1211 | gnl|Fabrus|L8__IGKJ1*01 | 830 | 1435 |
| 582 | gnl|Fabrus|VH3-23__IGHD5-5*01__IGHJ4*01 | 608 | 1213 | gnl|Fabrus|L8__IGKJ1*01 | 830 | 1435 |
| 583 | gnl|Fabrus|VH3-23__IGHD6-13*01__IGHJ4*01 | 609 | 1214 | gnl|Fabrus|L8__IGKJ1*01 | 830 | 1435 |
| 584 | gnl|Fabrus|VH3-23__IGHD7-27*01__IGHJ4*01 | 612 | 1217 | gnl|Fabrus|L8__IGKJ1*01 | 830 | 1435 |
| 585 | gnl|Fabrus|VH3-23__IGHD7-27*01__IGHJ6*01 | 613 | 1218 | gnl|Fabrus|L8__IGKJ1*01 | 830 | 1435 |
| 586 | gnl|Fabrus|VH1-69__IGHD1-14*01__IGHJ4*01 | 502 | 1107 | gnl|Fabrus|L8__IGKJ1*01 | 830 | 1435 |
| 587 | gnl|Fabrus|VH1-69__IGHD2-2*01__IGHJ4*01 | 503 | 1108 | gnl|Fabrus|L8__IGKJ1*01 | 830 | 1435 |
| 588 | gnl|Fabrus|VH1-69__IGHD2-8*01__IGHJ6*01 | 504 | 1109 | gnl|Fabrus|L8__IGKJ1*01 | 830 | 1435 |
| 589 | gnl|Fabrus|VH1-69__IGHD3-16*01__IGHJ4*01 | 505 | 1110 | gnl|Fabrus|L8__IGKJ1*01 | 830 | 1435 |
| 590 | gnl|Fabrus|VH1-69__IGHD3-3*01__IGHJ4*01 | 506 | 1111 | gnl|Fabrus|L8__IGKJ1*01 | 830 | 1435 |
| 591 | gnl|Fabrus|VH1-69__IGHD4-17*01__IGHJ4*01 | 508 | 1113 | gnl|Fabrus|L8__IGKJ1*01 | 830 | 1435 |
| 592 | gnl|Fabrus|VH1-69__IGHD5-12*01__IGHJ4*01 | 509 | 1114 | gnl|Fabrus|L8__IGKJ1*01 | 830 | 1435 |
| 593 | gnl|Fabrus|VH1-69__IGHD6-19*01__IGHJ4*01 | 511 | 1116 | gnl|Fabrus|L8__IGKJ1*01 | 830 | 1435 |
| 594 | gnl|Fabrus|VH1-69__IGHD7-27*01__IGHJ4*01 | 513 | 1118 | gnl|Fabrus|L8__IGKJ1*01 | 830 | 1435 |
| 595 | gnl|Fabrus|VH4-34__IGHD1-7*01__IGHJ4*01 | 749 | 1354 | gnl|Fabrus|L8__IGKJ1*01 | 830 | 1435 |
| 596 | gnl|Fabrus|VH4-34__IGHD2-2*01__IGHJ4*01 | 750 | 1355 | gnl|Fabrus|L8__IGKJ1*01 | 830 | 1435 |
| 597 | gnl|Fabrus|VH4-34__IGHD3-16*01__IGHJ4*01 | 751 | 1356 | gnl|Fabrus|L8__IGKJ1*01 | 830 | 1435 |
| 598 | gnl|Fabrus|VH4-34__IGHD4-17*01__IGHJ4*01 | 753 | 1358 | gnl|Fabrus|L8__IGKJ1*01 | 830 | 1435 |
| 599 | gnl|Fabrus|VH4-34__IGHD5-12*01__IGHJ4*01 | 754 | 1359 | gnl|Fabrus|L8__IGKJ1*01 | 830 | 1435 |
| 600 | gnl|Fabrus|VH4-34__IGHD6-13*01__IGHJ4*01 | 755 | 1360 | gnl|Fabrus|L8__IGKJ1*01 | 830 | 1435 |
| 601 | gnl|Fabrus|VH4-34__IGHD6-25*01__IGHJ6*01 | 756 | 1361 | gnl|Fabrus|L8__IGKJ1*01 | 830 | 1435 |
| 602 | gnl|Fabrus|VH4-34__IGHD7-27*01__IGHJ4*01 | 758 | 1363 | gnl|Fabrus|L8__IGKJ1*01 | 830 | 1435 |
| 603 | gnl|Fabrus|VH2-26__IGHD1-20*01__IGHJ4*01 | 521 | 1126 | gnl|Fabrus|L8__IGKJ1*01 | 830 | 1435 |
| 604 | gnl|Fabrus|VH2-26__IGHD2-2*01__IGHJ4*01 | 523 | 1128 | gnl|Fabrus|L8__IGKJ1*01 | 830 | 1435 |
| 605 | gnl|Fabrus|VH2-26__IGHD3-10*01__IGHJ4*01 | 524 | 1129 | gnl|Fabrus|L8__IGKJ1*01 | 830 | 1435 |
| 606 | gnl|Fabrus|VH2-26__IGHD4-11*01__IGHJ4*01 | 526 | 1131 | gnl|Fabrus|L8__IGKJ1*01 | 830 | 1435 |
| 607 | gnl|Fabrus|VH2-26__IGHD5-18*01__IGHJ4*01 | 528 | 1133 | gnl|Fabrus|L8__IGKJ1*01 | 830 | 1435 |
| 608 | gnl|Fabrus|VH2-26__IGHD6-13*01__IGHJ4*01 | 529 | 1134 | gnl|Fabrus|L8__IGKJ1*01 | 830 | 1435 |
| 609 | gnl|Fabrus|VH2-26__IGHD7-27*01__IGHJ4*01 | 530 | 1135 | gnl|Fabrus|L8__IGKJ1*01 | 830 | 1435 |
| 610 | gnl|Fabrus|VH5-51__IGHD1-14*01__IGHJ4*01 | 776 | 1381 | gnl|Fabrus|L8__IGKJ1*01 | 830 | 1435 |
| 611 | gnl|Fabrus|VH5-51__IGHD2-8*01__IGHJ4*01 | 778 | 1383 | gnl|Fabrus|L8__IGKJ1*01 | 830 | 1435 |
| 612 | gnl|Fabrus|VH5-51__IGHD3-3*01__IGHJ4*01 | 780 | 1385 | gnl|Fabrus|L8__IGKJ1*01 | 830 | 1435 |
| 613 | gnl|Fabrus|VH5-51__IGHD4-17*01__IGHJ4*01 | 781 | 1386 | gnl|Fabrus|L8__IGKJ1*01 | 830 | 1435 |
| 614 | gnl|Fabrus|VH5-51__IGHD5-18*01>3__IGHJ4*01 | 782 | 1387 | gnl|Fabrus|L8__IGKJ1*01 | 830 | 1435 |
| 615 | gnl|Fabrus|VH5-51__IGHD5-18*01>1__IGHJ4*01 | 783 | 1388 | gnl|Fabrus|L8__IGKJ1*01 | 830 | 1435 |
| 616 | gnl|Fabrus|VH5-51__IGHD6-25*01__IGHJ4*01 | 784 | 1389 | gnl|Fabrus|L8__IGKJ1*01 | 830 | 1435 |
| 617 | gnl|Fabrus|VH5-51__IGHD7-27*01__IGHJ4*01 | 785 | 1390 | gnl|Fabrus|L8__IGKJ1*01 | 830 | 1435 |
| 618 | gnl|Fabrus|VH6-1__IGHD1-1*01__IGHJ4*01 | 786 | 1391 | gnl|Fabrus|L8__IGKJ1*01 | 830 | 1435 |
| 619 | gnl|Fabrus|VH6-1__IGHD2-15*01__IGHJ4*01 | 788 | 1393 | gnl|Fabrus|L8__IGKJ1*01 | 830 | 1435 |
| 620 | gnl|Fabrus|VH6-1__IGHD3-3*01__IGHJ4*01 | 791 | 1396 | gnl|Fabrus|L8__IGKJ1*01 | 830 | 1435 |
| 621 | gnl|Fabrus|VH6-1__IGHD4-23*01__IGHJ4*01 | 793 | 1398 | gnl|Fabrus|L8__IGKJ1*01 | 830 | 1435 |
| 622 | gnl|Fabrus|VH6-1__IGHD4-11*01__IGHJ6*01 | 792 | 1397 | gnl|Fabrus|L8__IGKJ1*01 | 830 | 1435 |
| 623 | gnl|Fabrus|VH6-1__IGHD5-5*01__IGHJ4*01 | 794 | 1399 | gnl|Fabrus|L8__IGKJ1*01 | 830 | 1435 |
| 624 | gnl|Fabrus|VH6-1__IGHD6-13*01__IGHJ4*01 | 795 | 1400 | gnl|Fabrus|L8__IGKJ1*01 | 830 | 1435 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 625 | gnl\|Fabrus\|VH6-1__IGHD6-25*01__IGHJ6*01 | 796 | 1401 | gnl\|Fabrus\|L8__IGKJ1*01 | 830 | 1435 |
| 626 | gnl\|Fabrus\|VH6-1__IGHD7-27*01__IGHJ4*01 | 797 | 1402 | gnl\|Fabrus\|L8__IGKJ1*01 | 830 | 1435 |
| 627 | gnl\|Fabrus\|VH4-59__IGHD6-25*01__IGHJ3*01 | 775 | 1380 | gnl\|Fabrus\|L8__IGKJ1*01 | 830 | 1435 |
| 628 | gnl\|Fabrus\|VH3-48__IGHD6-6*01__IGHJ1*01 | 655 | 1260 | gnl\|Fabrus\|L8__IGKJ1*01 | 830 | 1435 |
| 629 | gnl\|Fabrus\|VH3-30__IGHD6-6*01__IGHJ1*01 | 625 | 1230 | gnl\|Fabrus\|L8__IGKJ1*01 | 830 | 1435 |
| 630 | gnl\|Fabrus\|VH3-66__IGHD6-6*01__IGHJ1*01 | 681 | 1286 | gnl\|Fabrus\|L8__IGKJ1*01 | 830 | 1435 |
| 631 | gnl\|Fabrus\|VH3-53__IGHD5-5*01__IGHJ4*01 | 670 | 1275 | gnl\|Fabrus\|L8__IGKJ1*01 | 830 | 1435 |
| 632 | gnl\|Fabrus\|VH2-5__IGHD5-12*01__IGHJ4*01 | 536 | 1141 | gnl\|Fabrus\|L8__IGKJ1*01 | 830 | 1435 |
| 633 | gnl\|Fabrus\|VH2-70__IGHD5-12*01__IGHJ4*01 | 543 | 1148 | gnl\|Fabrus\|L8__IGKJ1*01 | 830 | 1435 |
| 634 | gnl\|Fabrus\|VH3-15__IGHD5-12*01__IGHJ4*01 | 567 | 1172 | gnl\|Fabrus\|L8__IGKJ1*01 | 830 | 1435 |
| 635 | gnl\|Fabrus\|VH3-15__IGHD3-10*01__IGHJ4*01 | 565 | 1170 | gnl\|Fabrus\|L8__IGKJ1*01 | 830 | 1435 |
| 636 | gnl\|Fabrus\|VH3-49__IGHD5-18*01__IGHJ4*01 | 662 | 1267 | gnl\|Fabrus\|L8__IGKJ1*01 | 830 | 1435 |
| 637 | gnl\|Fabrus\|VH3-49__IGHD6-13*01__IGHJ4*01 | 663 | 1268 | gnl\|Fabrus\|L8__IGKJ1*01 | 830 | 1435 |
| 638 | gnl\|Fabrus\|VH3-72__IGHD5-18*01__IGHJ4*01 | 699 | 1304 | gnl\|Fabrus\|L8__IGKJ1*01 | 830 | 1435 |
| 639 | gnl\|Fabrus\|VH3-72__IGHD6-6*01__IGHJ1*01 | 701 | 1306 | gnl\|Fabrus\|L8__IGKJ1*01 | 830 | 1435 |
| 640 | gnl\|Fabrus\|VH3-73__IGHD5-12*01__IGHJ4*01 | 709 | 1314 | gnl\|Fabrus\|L8__IGKJ1*01 | 830 | 1435 |
| 641 | gnl\|Fabrus\|VH3-73__IGHD4-23*01__IGHJ5*01 | 708 | 1313 | gnl\|Fabrus\|L8__IGKJ1*01 | 830 | 1435 |
| 642 | gnl\|Fabrus\|VH3-43__IGHD3-22*01__IGHJ4*01 | 650 | 1255 | gnl\|Fabrus\|L8__IGKJ1*01 | 830 | 1435 |
| 643 | gnl\|Fabrus\|VH3-43__IGHD6-13*01__IGHJ4*01 | 653 | 1258 | gnl\|Fabrus\|L8__IGKJ1*01 | 830 | 1435 |
| 644 | gnl\|Fabrus\|VH3-9__IGHD3-22*01__IGHJ4*01 | 724 | 1329 | gnl\|Fabrus\|L8__IGKJ1*01 | 830 | 1435 |
| 645 | gnl\|Fabrus\|VH3-9__IGHD1-7*01__IGHJ5*01 | 721 | 1326 | gnl\|Fabrus\|L8__IGKJ1*01 | 830 | 1435 |
| 646 | gnl\|Fabrus\|VH3-9__IGHD6-13*01__IGHJ4*01 | 727 | 1332 | gnl\|Fabrus\|L8__IGKJ1*01 | 830 | 1435 |
| 647 | gnl\|Fabrus\|VH4-39__IGHD3-10*01__IGHJ4*01 | 762 | 1367 | gnl\|Fabrus\|L8__IGKJ1*01 | 830 | 1435 |
| 648 | gnl\|Fabrus\|VH4-39__IGHD5-12*01__IGHJ4*01 | 766 | 1371 | gnl\|Fabrus\|L8__IGKJ1*01 | 830 | 1435 |
| 649 | gnl\|Fabrus\|VH1-18__IGHD6-6*01__IGHJ1*01 | 460 | 1065 | gnl\|Fabrus\|L8__IGKJ1*01 | 830 | 1435 |
| 650 | gnl\|Fabrus\|VH1-24__IGHD5-12*01__IGHJ4*01 | 467 | 1072 | gnl\|Fabrus\|L8__IGKJ1*01 | 830 | 1435 |
| 651 | gnl\|Fabrus\|VH1-2__IGHD1-1*01__IGHJ3*01 | 461 | 1066 | gnl\|Fabrus\|L8__IGKJ1*01 | 830 | 1435 |
| 652 | gnl\|Fabrus\|VH1-3__IGHD6-6*01__IGHJ1*01 | 475 | 1080 | gnl\|Fabrus\|L8__IGKJ1*01 | 830 | 1435 |
| 653 | gnl\|Fabrus\|VH1-45__IGHD3-10*01__IGHJ4*01 | 480 | 1085 | gnl\|Fabrus\|L8__IGKJ1*01 | 830 | 1435 |
| 654 | gnl\|Fabrus\|VH1-46__IGHD1-26*01__IGHJ4*01 | 486 | 1091 | gnl\|Fabrus\|L8__IGKJ1*01 | 830 | 1435 |
| 655 | gnl\|Fabrus\|VH7-81__IGHD2-21*01__IGHJ6*01 | 800 | 1405 | gnl\|Fabrus\|L8__IGKJ1*01 | 830 | 1435 |
| 656 | gnl\|Fabrus\|VH2-70__IGHD3-9*01__IGHJ6*01 | 542 | 1147 | gnl\|Fabrus\|L8__IGKJ1*01 | 830 | 1435 |
| 657 | gnl\|Fabrus\|VH1-58__IGHD3-10*01__IGHJ6*01 | 496 | 1101 | gnl\|Fabrus\|L8__IGKJ1*01 | 830 | 1435 |
| 658 | gnl\|Fabrus\|VH7-81__IGHD2-21*01__IGHJ2*01 | 799 | 1404 | gnl\|Fabrus\|L8__IGKJ1*01 | 830 | 1435 |
| 659 | gnl\|Fabrus\|VH4-28__IGHD3-9*01__IGHJ6*01 | 734 | 1339 | gnl\|Fabrus\|L8__IGKJ1*01 | 830 | 1435 |
| 660 | gnl\|Fabrus\|VH4-31__IGHD2-15*01__IGHJ2*01 | 740 | 1345 | gnl\|Fabrus\|L8__IGKJ1*01 | 830 | 1435 |
| 661 | gnl\|Fabrus\|VH2-5__IGHD3-9*01__IGHJ6*01 | 535 | 1140 | gnl\|Fabrus\|L8__IGKJ1*01 | 830 | 1435 |
| 662 | gnl\|Fabrus\|VH1-8__IGHD2-15*01__IGHJ6*01 | 515 | 1120 | gnl\|Fabrus\|L8__IGKJ1*01 | 830 | 1435 |
| 663 | gnl\|Fabrus\|VH2-70__IGHD2-15*01__IGHJ2*01 | 540 | 1145 | gnl\|Fabrus\|L8__IGKJ1*01 | 830 | 1435 |
| 664 | gnl\|Fabrus\|VH3-38__IGHD3-10*01__IGHJ4*01 | 639 | 1244 | gnl\|Fabrus\|L8__IGKJ1*01 | 830 | 1435 |
| 665 | gnl\|Fabrus\|VH3-16__IGHD1-7*01__IGHJ6*01 | 570 | 1175 | gnl\|Fabrus\|L8__IGKJ1*01 | 830 | 1435 |
| 666 | gnl\|Fabrus\|VH3-73__IGHD3-9*01__IGHJ6*01 | 706 | 1311 | gnl\|Fabrus\|L8__IGKJ1*01 | 830 | 1435 |
| 667 | gnl\|Fabrus\|VH3-11__IGHD3-9*01__IGHJ6*01 | 548 | 1153 | gnl\|Fabrus\|L8__IGKJ1*01 | 830 | 1435 |
| 668 | gnl\|Fabrus\|VH3-11__IGHD6-6*01__IGHJ1*01 | 552 | 1157 | gnl\|Fabrus\|L8__IGKJ1*01 | 830 | 1435 |
| 669 | gnl\|Fabrus\|VH3-20__IGHD5-12*01__IGHJ4*01 | 584 | 1189 | gnl\|Fabrus\|L8__IGKJ1*01 | 830 | 1435 |
| 670 | gnl\|Fabrus\|VH3-16__IGHD2-15*01__IGHJ2*01 | 571 | 1176 | gnl\|Fabrus\|L8__IGKJ1*01 | 830 | 1435 |
| 671 | gnl\|Fabrus\|VH3-7__IGHD6-6*01__IGHJ1*01 | 692 | 1297 | gnl\|Fabrus\|L8__IGKJ1*01 | 830 | 1435 |
| 672 | gnl\|Fabrus\|VH3-16__IGHD6-13*01__IGHJ4*01 | 576 | 1181 | gnl\|Fabrus\|L8__IGKJ1*01 | 830 | 1435 |
| 673 | gnl\|Fabrus\|VH3-23__IGHD1-1*01__IGHJ4*01 | 595 | 1200 | gnl\|Fabrus\|L11__IGKJ1*01 | 819 | 1424 |
| 674 | gnl\|Fabrus\|VH3-23__IGHD2-15*01__IGHJ4*01 | 598 | 1203 | gnl\|Fabrus\|L11__IGKJ1*01 | 819 | 1424 |
| 675 | gnl\|Fabrus\|VH3-23__IGHD3-22*01__IGHJ4*01 | 602 | 1207 | gnl\|Fabrus\|L11__IGKJ1*01 | 819 | 1424 |
| 676 | gnl\|Fabrus\|VH3-23__IGHD4-11*01__IGHJ4*01 | 604 | 1209 | gnl\|Fabrus\|L11__IGKJ1*01 | 819 | 1424 |
| 677 | gnl\|Fabrus\|VH3-23__IGHD5-12*01__IGHJ4*01 | 606 | 1211 | gnl\|Fabrus\|L11__IGKJ1*01 | 819 | 1424 |
| 678 | gnl\|Fabrus\|VH3-23__IGHD5-5*01__IGHJ4*01 | 608 | 1213 | gnl\|Fabrus\|L11__IGKJ1*01 | 819 | 1424 |
| 679 | gnl\|Fabrus\|VH3-23__IGHD6-13*01__IGHJ4*01 | 609 | 1214 | gnl\|Fabrus\|L11__IGKJ1*01 | 819 | 1424 |
| 680 | gnl\|Fabrus\|VH3-23__IGHD7-27*01__IGHJ4*01 | 612 | 1217 | gnl\|Fabrus\|L11__IGKJ1*01 | 819 | 1424 |
| 681 | gnl\|Fabrus\|VH3-23__IGHD7-27*01__IGHJ6*01 | 613 | 1218 | gnl\|Fabrus\|L11__IGKJ1*01 | 819 | 1424 |
| 682 | gnl\|Fabrus\|VH1-69__IGHD1-14*01__IGHJ4*01 | 502 | 1107 | gnl\|Fabrus\|L11__IGKJ1*01 | 819 | 1424 |
| 683 | gnl\|Fabrus\|VH1-69__IGHD2-2*01__IGHJ4*01 | 503 | 1108 | gnl\|Fabrus\|L11__IGKJ1*01 | 819 | 1424 |
| 684 | gnl\|Fabrus\|VH1-69__IGHD2-8*01__IGHJ6*01 | 504 | 1109 | gnl\|Fabrus\|L11__IGKJ1*01 | 819 | 1424 |
| 685 | gnl\|Fabrus\|VH1-69__IGHD3-16*01__IGHJ4*01 | 505 | 1110 | gnl\|Fabrus\|L11__IGKJ1*01 | 819 | 1424 |
| 686 | gnl\|Fabrus\|VH1-69__IGHD3-3*01__IGHJ4*01 | 506 | 1111 | gnl\|Fabrus\|L11__IGKJ1*01 | 819 | 1424 |
| 687 | gnl\|Fabrus\|VH1-69__IGHD4-17*01__IGHJ4*01 | 508 | 1113 | gnl\|Fabrus\|L11__IGKJ1*01 | 819 | 1424 |
| 688 | gnl\|Fabrus\|VH1-69__IGHD5-12*01__IGHJ4*01 | 509 | 1114 | gnl\|Fabrus\|L11__IGKJ1*01 | 819 | 1424 |
| 689 | gnl\|Fabrus\|VH1-69__IGHD6-19*01__IGHJ4*01 | 511 | 1116 | gnl\|Fabrus\|L11__IGKJ1*01 | 819 | 1424 |
| 690 | gnl\|Fabrus\|VH1-69__IGHD7-27*01__IGHJ4*01 | 513 | 1118 | gnl\|Fabrus\|L11__IGKJ1*01 | 819 | 1424 |
| 691 | gnl\|Fabrus\|VH4-34__IGHD1-7*01__IGHJ4*01 | 749 | 1354 | gnl\|Fabrus\|L11__IGKJ1*01 | 819 | 1424 |
| 692 | gnl\|Fabrus\|VH4-34__IGHD2-2*01__IGHJ4*01 | 750 | 1355 | gnl\|Fabrus\|L11__IGKJ1*01 | 819 | 1424 |
| 693 | gnl\|Fabrus\|VH4-34__IGHD3-16*01__IGHJ4*01 | 751 | 1356 | gnl\|Fabrus\|L11__IGKJ1*01 | 819 | 1424 |
| 694 | gnl\|Fabrus\|VH4-34__IGHD4-17*01__IGHJ4*01 | 753 | 1358 | gnl\|Fabrus\|L11__IGKJ1*01 | 819 | 1424 |
| 695 | gnl\|Fabrus\|VH4-34__IGHD5-12*01__IGHJ4*01 | 754 | 1359 | gnl\|Fabrus\|L11__IGKJ1*01 | 819 | 1424 |
| 696 | gnl\|Fabrus\|VH4-34__IGHD6-13*01__IGHJ4*01 | 755 | 1360 | gnl\|Fabrus\|L11__IGKJ1*01 | 819 | 1424 |
| 697 | gnl\|Fabrus\|VH4-34__IGHD6-25*01__IGHJ6*01 | 756 | 1361 | gnl\|Fabrus\|L11__IGKJ1*01 | 819 | 1424 |
| 698 | gnl\|Fabrus\|VH4-34__IGHD7-27*01__IGHJ4*01 | 758 | 1363 | gnl\|Fabrus\|L11__IGKJ1*01 | 819 | 1424 |
| 699 | gnl\|Fabrus\|VH2-26__IGHD1-20*01__IGHJ4*01 | 521 | 1126 | gnl\|Fabrus\|L11__IGKJ1*01 | 819 | 1424 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 700 | gnl\|Fabrus\|VH2-26__IGHD2-2*01__IGHJ4*01 | 523 | 1128 | gnl\|Fabrus\|L11__IGKJ1*01 | 819 | 1424 |
| 701 | gnl\|Fabrus\|VH2-26__IGHD3-10*01__IGHJ4*01 | 524 | 1129 | gnl\|Fabrus\|L11__IGKJ1*01 | 819 | 1424 |
| 702 | gnl\|Fabrus\|VH2-26__IGHD4-11*01__IGHJ4*01 | 526 | 1131 | gnl\|Fabrus\|L11__IGKJ1*01 | 819 | 1424 |
| 703 | gnl\|Fabrus\|VH2-26__IGHD5-18*01__IGHJ4*01 | 528 | 1133 | gnl\|Fabrus\|L11__IGKJ1*01 | 819 | 1424 |
| 704 | gnl\|Fabrus\|VH2-26__IGHD6-13*01__IGHJ4*01 | 529 | 1134 | gnl\|Fabrus\|L11__IGKJ1*01 | 819 | 1424 |
| 705 | gnl\|Fabrus\|VH2-26__IGHD7-27*01__IGHJ4*01 | 530 | 1135 | gnl\|Fabrus\|L11__IGKJ1*01 | 819 | 1424 |
| 706 | gnl\|Fabrus\|VH5-51__IGHD1-14*01__IGHJ4*01 | 776 | 1381 | gnl\|Fabrus\|L11__IGKJ1*01 | 819 | 1424 |
| 707 | gnl\|Fabrus\|VH5-51__IGHD2-8*01__IGHJ4*01 | 778 | 1383 | gnl\|Fabrus\|L11__IGKJ1*01 | 819 | 1424 |
| 708 | gnl\|Fabrus\|VH5-51__IGHD3-3*01__IGHJ4*01 | 780 | 1385 | gnl\|Fabrus\|L11__IGKJ1*01 | 819 | 1424 |
| 709 | gnl\|Fabrus\|VH5-51__IGHD4-17*01__IGHJ4*01 | 781 | 1386 | gnl\|Fabrus\|L11__IGKJ1*01 | 819 | 1424 |
| 710 | gnl\|Fabrus\|VH5-51__IGHD5-18*01>3__IGHJ4*01 | 782 | 1387 | gnl\|Fabrus\|L11__IGKJ1*01 | 819 | 1424 |
| 711 | gnl\|Fabrus\|VH5-51__IGHD5-18*01>1__IGHJ4*01 | 783 | 1388 | gnl\|Fabrus\|L11__IGKJ1*01 | 819 | 1424 |
| 712 | gnl\|Fabrus\|VH5-51__IGHD6-25*01__IGHJ4*01 | 784 | 1389 | gnl\|Fabrus\|L11__IGKJ1*01 | 819 | 1424 |
| 713 | gnl\|Fabrus\|VH5-51__IGHD7-27*01__IGHJ4*01 | 785 | 1390 | gnl\|Fabrus\|L11__IGKJ1*01 | 819 | 1424 |
| 714 | gnl\|Fabrus\|VH6-1__IGHD1-1*01__IGHJ4*01 | 786 | 1391 | gnl\|Fabrus\|L11__IGKJ1*01 | 819 | 1424 |
| 715 | gnl\|Fabrus\|VH6-1__IGHD2-15*01__IGHJ4*01 | 788 | 1393 | gnl\|Fabrus\|L11__IGKJ1*01 | 819 | 1424 |
| 716 | gnl\|Fabrus\|VH6-1__IGHD3-3*01__IGHJ4*01 | 791 | 1396 | gnl\|Fabrus\|L11__IGKJ1*01 | 819 | 1424 |
| 717 | gnl\|Fabrus\|VH6-1__IGHD4-23*01__IGHJ4*01 | 793 | 1398 | gnl\|Fabrus\|L11__IGKJ1*01 | 819 | 1424 |
| 718 | gnl\|Fabrus\|VH6-1__IGHD4-11*01__IGHJ6*01 | 792 | 1397 | gnl\|Fabrus\|L11__IGKJ1*01 | 819 | 1424 |
| 719 | gnl\|Fabrus\|VH6-1__IGHD5-5*01__IGHJ4*01 | 794 | 1399 | gnl\|Fabrus\|L11__IGKJ1*01 | 819 | 1424 |
| 720 | gnl\|Fabrus\|VH6-1__IGHD6-13*01__IGHJ4*01 | 795 | 1400 | gnl\|Fabrus\|L11__IGKJ1*01 | 819 | 1424 |
| 721 | gnl\|Fabrus\|VH6-1__IGHD6-25*01__IGHJ6*01 | 796 | 1401 | gnl\|Fabrus\|L11__IGKJ1*01 | 819 | 1424 |
| 722 | gnl\|Fabrus\|VH6-1__IGHD7-27*01__IGHJ4*01 | 797 | 1402 | gnl\|Fabrus\|L11__IGKJ1*01 | 819 | 1424 |
| 723 | gnl\|Fabrus\|VH4-59__IGHD6-25*01__IGHJ3*01 | 775 | 1380 | gnl\|Fabrus\|L11__IGKJ1*01 | 819 | 1424 |
| 724 | gnl\|Fabrus\|VH3-48__IGHD6-6*01__IGHJ1*01 | 655 | 1260 | gnl\|Fabrus\|L11__IGKJ1*01 | 819 | 1424 |
| 725 | gnl\|Fabrus\|VH3-30__IGHD6-6*01__IGHJ1*01 | 625 | 1230 | gnl\|Fabrus\|L11__IGKJ1*01 | 819 | 1424 |
| 726 | gnl\|Fabrus\|VH3-66__IGHD6-6*01__IGHJ1*01 | 681 | 1286 | gnl\|Fabrus\|L11__IGKJ1*01 | 819 | 1424 |
| 727 | gnl\|Fabrus\|VH3-53__IGHD5-5*01__IGHJ4*01 | 670 | 1275 | gnl\|Fabrus\|L11__IGKJ1*01 | 819 | 1424 |
| 728 | gnl\|Fabrus\|VH2-5__IGHD5-12*01__IGHJ4*01 | 536 | 1141 | gnl\|Fabrus\|L11__IGKJ1*01 | 819 | 1424 |
| 729 | gnl\|Fabrus\|VH2-70__IGHD5-12*01__IGHJ4*01 | 543 | 1148 | gnl\|Fabrus\|L11__IGKJ1*01 | 819 | 1424 |
| 730 | gnl\|Fabrus\|VH3-15__IGHD5-12*01__IGHJ4*01 | 567 | 1172 | gnl\|Fabrus\|L11__IGKJ1*01 | 819 | 1424 |
| 731 | gnl\|Fabrus\|VH3-15__IGHD3-10*01__IGHJ4*01 | 565 | 1170 | gnl\|Fabrus\|L11__IGKJ1*01 | 819 | 1424 |
| 732 | gnl\|Fabrus\|VH3-49__IGHD5-18*01__IGHJ4*01 | 662 | 1267 | gnl\|Fabrus\|L11__IGKJ1*01 | 819 | 1424 |
| 733 | gnl\|Fabrus\|VH3-49__IGHD6-13*01__IGHJ4*01 | 663 | 1268 | gnl\|Fabrus\|L11__IGKJ1*01 | 819 | 1424 |
| 734 | gnl\|Fabrus\|VH3-72__IGHD5-18*01__IGHJ4*01 | 699 | 1304 | gnl\|Fabrus\|L11__IGKJ1*01 | 819 | 1424 |
| 735 | gnl\|Fabrus\|VH3-72__IGHD6-6*01__IGHJ1*01 | 701 | 1306 | gnl\|Fabrus\|L11__IGKJ1*01 | 819 | 1424 |
| 736 | gnl\|Fabrus\|VH3-73__IGHD5-12*01__IGHJ4*01 | 709 | 1314 | gnl\|Fabrus\|L11__IGKJ1*01 | 819 | 1424 |
| 737 | gnl\|Fabrus\|VH3-73__IGHD4-23*01__IGHJ5*01 | 708 | 1313 | gnl\|Fabrus\|L11__IGKJ1*01 | 819 | 1424 |
| 738 | gnl\|Fabrus\|VH3-43__IGHD3-22*01__IGHJ4*01 | 650 | 1255 | gnl\|Fabrus\|L11__IGKJ1*01 | 819 | 1424 |
| 739 | gnl\|Fabrus\|VH3-43__IGHD6-13*01__IGHJ4*01 | 653 | 1258 | gnl\|Fabrus\|L11__IGKJ1*01 | 819 | 1424 |
| 740 | gnl\|Fabrus\|VH3-9__IGHD3-22*01__IGHJ4*01 | 724 | 1329 | gnl\|Fabrus\|L11__IGKJ1*01 | 819 | 1424 |
| 741 | gnl\|Fabrus\|VH3-9__IGHD1-7*01__IGHJ5*01 | 721 | 1326 | gnl\|Fabrus\|L11__IGKJ1*01 | 819 | 1424 |
| 742 | gnl\|Fabrus\|VH3-9__IGHD6-13*01__IGHJ4*01 | 727 | 1332 | gnl\|Fabrus\|L11__IGKJ1*01 | 819 | 1424 |
| 743 | gnl\|Fabrus\|VH4-39__IGHD3-10*01__IGHJ4*01 | 762 | 1367 | gnl\|Fabrus\|L11__IGKJ1*01 | 819 | 1424 |
| 744 | gnl\|Fabrus\|VH4-39__IGHD5-12*01__IGHJ4*01 | 766 | 1371 | gnl\|Fabrus\|L11__IGKJ1*01 | 819 | 1424 |
| 745 | gnl\|Fabrus\|VH1-18__IGHD6-6*01__IGHJ1*01 | 460 | 1065 | gnl\|Fabrus\|L11__IGKJ1*01 | 819 | 1424 |
| 746 | gnl\|Fabrus\|VH1-24__IGHD5-12*01__IGHJ4*01 | 467 | 1072 | gnl\|Fabrus\|L11__IGKJ1*01 | 819 | 1424 |
| 747 | gnl\|Fabrus\|VH1-2__IGHD1-1*01__IGHJ3*01 | 461 | 1066 | gnl\|Fabrus\|L11__IGKJ1*01 | 819 | 1424 |
| 748 | gnl\|Fabrus\|VH1-3__IGHD6-6*01__IGHJ1*01 | 475 | 1080 | gnl\|Fabrus\|L11__IGKJ1*01 | 819 | 1424 |
| 749 | gnl\|Fabrus\|VH1-45__IGHD3-10*01__IGHJ4*01 | 480 | 1085 | gnl\|Fabrus\|L11__IGKJ1*01 | 819 | 1424 |
| 750 | gnl\|Fabrus\|VH1-46__IGHD1-26*01__IGHJ4*01 | 486 | 1091 | gnl\|Fabrus\|L11__IGKJ1*01 | 819 | 1424 |
| 751 | gnl\|Fabrus\|VH7-81__IGHD2-21*01__IGHJ6*01 | 800 | 1405 | gnl\|Fabrus\|L11__IGKJ1*01 | 819 | 1424 |
| 752 | gnl\|Fabrus\|VH2-70__IGHD3-9*01__IGHJ6*01 | 542 | 1147 | gnl\|Fabrus\|L11__IGKJ1*01 | 819 | 1424 |
| 753 | gnl\|Fabrus\|VH1-58__IGHD3-10*01__IGHJ6*01 | 496 | 1101 | gnl\|Fabrus\|L11__IGKJ1*01 | 819 | 1424 |
| 754 | gnl\|Fabrus\|VH7-81__IGHD2-21*01__IGHJ2*01 | 799 | 1404 | gnl\|Fabrus\|L11__IGKJ1*01 | 819 | 1424 |
| 755 | gnl\|Fabrus\|VH4-28__IGHD3-9*01__IGHJ6*01 | 734 | 1339 | gnl\|Fabrus\|L11__IGKJ1*01 | 819 | 1424 |
| 756 | gnl\|Fabrus\|VH4-31__IGHD2-15*01__IGHJ2*01 | 740 | 1345 | gnl\|Fabrus\|L11__IGKJ1*01 | 819 | 1424 |
| 757 | gnl\|Fabrus\|VH2-5__IGHD3-9*01__IGHJ6*01 | 535 | 1140 | gnl\|Fabrus\|L11__IGKJ1*01 | 819 | 1424 |
| 758 | gnl\|Fabrus\|VH1-8__IGHD2-15*01__IGHJ6*01 | 515 | 1120 | gnl\|Fabrus\|L11__IGKJ1*01 | 819 | 1424 |
| 759 | gnl\|Fabrus\|VH2-70__IGHD2-15*01__IGHJ2*01 | 540 | 1145 | gnl\|Fabrus\|L11__IGKJ1*01 | 819 | 1424 |
| 760 | gnl\|Fabrus\|VH3-38__IGHD3-10*01__IGHJ4*01 | 639 | 1244 | gnl\|Fabrus\|L11__IGKJ1*01 | 819 | 1424 |
| 761 | gnl\|Fabrus\|VH3-16__IGHD1-7*01__IGHJ6*01 | 570 | 1175 | gnl\|Fabrus\|L11__IGKJ1*01 | 819 | 1424 |
| 762 | gnl\|Fabrus\|VH3-73__IGHD3-9*01__IGHJ6*01 | 706 | 1311 | gnl\|Fabrus\|L11__IGKJ1*01 | 819 | 1424 |
| 763 | gnl\|Fabrus\|VH3-11__IGHD3-9*01__IGHJ6*01 | 548 | 1153 | gnl\|Fabrus\|L11__IGKJ1*01 | 819 | 1424 |
| 764 | gnl\|Fabrus\|VH3-11__IGHD6-6*01__IGHJ1*01 | 552 | 1157 | gnl\|Fabrus\|L11__IGKJ1*01 | 819 | 1424 |
| 765 | gnl\|Fabrus\|VH3-20__IGHD5-12*01__IGHJ4*01 | 584 | 1189 | gnl\|Fabrus\|L11__IGKJ1*01 | 819 | 1424 |
| 766 | gnl\|Fabrus\|VH3-16__IGHD2-15*01__IGHJ2*01 | 571 | 1176 | gnl\|Fabrus\|L11__IGKJ1*01 | 819 | 1424 |
| 767 | gnl\|Fabrus\|VH3-7__IGHD6-6*01__IGHJ1*01 | 692 | 1297 | gnl\|Fabrus\|L11__IGKJ1*01 | 819 | 1424 |
| 768 | gnl\|Fabrus\|VH3-16__IGHD6-13*01__IGHJ4*01 | 576 | 1181 | gnl\|Fabrus\|L11__IGKJ1*01 | 819 | 1424 |
| 769 | gnl\|Fabrus\|VH3-23__IGHD1-1*01__IGHJ4*01 | 595 | 1200 | gnl\|Fabrus\|L12__IGKJ1*01 | 820 | 1425 |
| 770 | gnl\|Fabrus\|VH3-23__IGHD2-15*01__IGHJ4*01 | 598 | 1203 | gnl\|Fabrus\|L12__IGKJ1*01 | 820 | 1425 |
| 771 | gnl\|Fabrus\|VH3-23__IGHD3-22*01__IGHJ4*01 | 602 | 1207 | gnl\|Fabrus\|L12__IGKJ1*01 | 820 | 1425 |
| 772 | gnl\|Fabrus\|VH3-23__IGHD4-11*01__IGHJ4*01 | 604 | 1209 | gnl\|Fabrus\|L12__IGKJ1*01 | 820 | 1425 |
| 773 | gnl\|Fabrus\|VH3-23__IGHD5-12*01__IGHJ4*01 | 606 | 1211 | gnl\|Fabrus\|L12__IGKJ1*01 | 820 | 1425 |
| 774 | gnl\|Fabrus\|VH3-23__IGHD5-5*01__IGHJ4*01 | 608 | 1213 | gnl\|Fabrus\|L12__IGKJ1*01 | 820 | 1425 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 775 | gnl\|Fabrus\|VH3-23__IGHD6-13*01__IGHJ*01 | 609 | 1214 | gnl\|Fabrus\|L12__IGKJ1*01 | 820 | 1425 |
| 776 | gnl\|Fabrus\|VH3-23__IGHD7-27*01__IGHJ4*01 | 612 | 1217 | gnl\|Fabrus\|L12__IGKJ1*01 | 820 | 1425 |
| 777 | gnl\|Fabrus\|VH3-23__IGHD7-27*01__IGHJ6*01 | 613 | 1218 | gnl\|Fabrus\|L12__IGKJ1*01 | 820 | 1425 |
| 778 | gnl\|Fabrus\|VH1-69__IGHD1-14*01__IGHJ4*01 | 502 | 1107 | gnl\|Fabrus\|L12__IGKJ1*01 | 820 | 1425 |
| 779 | gnl\|Fabrus\|VH1-69__IGHD2-2*01__IGHJ4*01 | 503 | 1108 | gnl\|Fabrus\|L12__IGKJ1*01 | 820 | 1425 |
| 780 | gnl\|Fabrus\|VH1-69__IGHD2-8*01__IGHJ6*01 | 504 | 1109 | gnl\|Fabrus\|L12__IGKJ1*01 | 820 | 1425 |
| 781 | gnl\|Fabrus\|VH1-69__IGHD3-16*01__IGHJ4*01 | 505 | 1110 | gnl\|Fabrus\|L12__IGKJ1*01 | 820 | 1425 |
| 782 | gnl\|Fabrus\|VH1-69__IGHD3-3*01__IGHJ4*01 | 506 | 1111 | gnl\|Fabrus\|L12__IGKJ1*01 | 820 | 1425 |
| 783 | gnl\|Fabrus\|VH1-69__IGHD4-17*01__IGHJ4*01 | 508 | 1113 | gnl\|Fabrus\|L12__IGKJ1*01 | 820 | 1425 |
| 784 | gnl\|Fabrus\|VH1-69__IGHD5-12*01__IGHJ4*01 | 509 | 1114 | gnl\|Fabrus\|L12__IGKJ1*01 | 820 | 1425 |
| 785 | gnl\|Fabrus\|VH1-69__IGHD6-19*01__IGHJ4*01 | 511 | 1116 | gnl\|Fabrus\|L12__IGKJ1*01 | 820 | 1425 |
| 786 | gnl\|Fabrus\|VH1-69__IGHD7-27*01__IGHJ4*01 | 513 | 1118 | gnl\|Fabrus\|L12__IGKJ1*01 | 820 | 1425 |
| 787 | gnl\|Fabrus\|VH4-34__IGHD1-7*01__IGHJ4*01 | 749 | 1354 | gnl\|Fabrus\|L12__IGKJ1*01 | 820 | 1425 |
| 788 | gnl\|Fabrus\|VH4-34__IGHD2-2*01__IGHJ4*01 | 750 | 1355 | gnl\|Fabrus\|L12__IGKJ1*01 | 820 | 1425 |
| 789 | gnl\|Fabrus\|VH4-34__IGHD3-16*01__IGHJ4*01 | 751 | 1356 | gnl\|Fabrus\|L12__IGKJ1*01 | 820 | 1425 |
| 790 | gnl\|Fabrus\|VH4-34__IGHD4-17*01__IGHJ4*01 | 753 | 1358 | gnl\|Fabrus\|L12__IGKJ1*01 | 820 | 1425 |
| 791 | gnl\|Fabrus\|VH4-34__IGHD5-12*01__IGHJ4*01 | 754 | 1359 | gnl\|Fabrus\|L12__IGKJ1*01 | 820 | 1425 |
| 792 | gnl\|Fabrus\|VH4-34__IGHD6-13*01__IGHJ4*01 | 755 | 1360 | gnl\|Fabrus\|L12__IGKJ1*01 | 820 | 1425 |
| 793 | gnl\|Fabrus\|VH4-34__IGHD6-25*01__IGHJ6*01 | 756 | 1361 | gnl\|Fabrus\|L12__IGKJ1*01 | 820 | 1425 |
| 794 | gnl\|Fabrus\|VH4-34__IGHD7-27*01__IGHJ4*01 | 758 | 1363 | gnl\|Fabrus\|L12__IGKJ1*01 | 820 | 1425 |
| 795 | gnl\|Fabrus\|VH2-26__IGHD1-20*01__IGHJ4*01 | 521 | 1126 | gnl\|Fabrus\|L12__IGKJ1*01 | 820 | 1425 |
| 796 | gnl\|Fabrus\|VH2-26__IGHD2-2*01__IGHJ4*01 | 523 | 1128 | gnl\|Fabrus\|L12__IGKJ1*01 | 820 | 1425 |
| 797 | gnl\|Fabrus\|VH2-26__IGHD3-10*01__IGHJ4*01 | 524 | 1129 | gnl\|Fabrus\|L12__IGKJ1*01 | 820 | 1425 |
| 798 | gnl\|Fabrus\|VH2-26__IGHD4-11*01__IGHJ4*01 | 526 | 1131 | gnl\|Fabrus\|L12__IGKJ1*01 | 820 | 1425 |
| 799 | gnl\|Fabrus\|VH2-26__IGHD5-18*01__IGHJ4*01 | 528 | 1133 | gnl\|Fabrus\|L12__IGKJ1*01 | 820 | 1425 |
| 800 | gnl\|Fabrus\|VH2-26__IGHD6-13*01__IGHJ4*01 | 529 | 1134 | gnl\|Fabrus\|L12__IGKJ1*01 | 820 | 1425 |
| 801 | gnl\|Fabrus\|VH2-26__IGHD7-27*01__IGHJ4*01 | 530 | 1135 | gnl\|Fabrus\|L12__IGKJ1*01 | 820 | 1425 |
| 802 | gnl\|Fabrus\|VH5-51__IGHD1-14*01__IGHJ4*01 | 776 | 1381 | gnl\|Fabrus\|L12__IGKJ1*01 | 820 | 1425 |
| 803 | gnl\|Fabrus\|VH5-51__IGHD2-8*01__IGHJ4*01 | 778 | 1383 | gnl\|Fabrus\|L12__IGKJ1*01 | 820 | 1425 |
| 804 | gnl\|Fabrus\|VH5-51__IGHD3-3*01__IGHJ4*01 | 780 | 1385 | gnl\|Fabrus\|L12__IGKJ1*01 | 820 | 1425 |
| 805 | gnl\|Fabrus\|VH5-51__IGHD4-17*01__IGHJ4*01 | 781 | 1386 | gnl\|Fabrus\|L12__IGKJ1*01 | 820 | 1425 |
| 806 | gnl\|Fabrus\|VH5-51__IGHD5-18*01>3__IGHJ4*01 | 782 | 1387 | gnl\|Fabrus\|L12__IGKJ1*01 | 820 | 1425 |
| 807 | gnl\|Fabrus\|VH5-51__IGHD5-18*01>1__IGHJ4*01 | 783 | 1388 | gnl\|Fabrus\|L12__IGKJ1*01 | 820 | 1425 |
| 808 | gnl\|Fabrus\|VH5-51__IGHD6-25*01__IGHJ4*01 | 784 | 1389 | gnl\|Fabrus\|L12__IGKJ1*01 | 820 | 1425 |
| 809 | gnl\|Fabrus\|VH5-51__IGHD7-27*01__IGHJ4*01 | 785 | 1390 | gnl\|Fabrus\|L12__IGKJ1*01 | 820 | 1425 |
| 810 | gnl\|Fabrus\|VH6-1__IGHD1-1*01__IGHJ4*01 | 786 | 1391 | gnl\|Fabrus\|L12__IGKJ1*01 | 820 | 1425 |
| 811 | gnl\|Fabrus\|VH6-1__IGHD2-15*01__IGHJ4*01 | 788 | 1393 | gnl\|Fabrus\|L12__IGKJ1*01 | 820 | 1425 |
| 812 | gnl\|Fabrus\|VH6-1__IGHD3-3*01__IGHJ4*01 | 791 | 1396 | gnl\|Fabrus\|L12__IGKJ1*01 | 820 | 1425 |
| 813 | gnl\|Fabrus\|VH6-1__IGHD4-23*01__IGHJ4*01 | 793 | 1398 | gnl\|Fabrus\|L12__IGKJ1*01 | 820 | 1425 |
| 814 | gnl\|Fabrus\|VH6-1__IGHD4-11*01__IGHJ6*01 | 792 | 1397 | gnl\|Fabrus\|L12__IGKJ1*01 | 820 | 1425 |
| 815 | gnl\|Fabrus\|VH6-1__IGHD5-5*01__IGHJ4*01 | 794 | 1399 | gnl\|Fabrus\|L12__IGKJ1*01 | 820 | 1425 |
| 816 | gnl\|Fabrus\|VH6-1__IGHD6-13*01__IGHJ4*01 | 795 | 1400 | gnl\|Fabrus\|L12__IGKJ1*01 | 820 | 1425 |
| 817 | gnl\|Fabrus\|VH6-1__IGHD6-25*01__IGHJ6*01 | 796 | 1401 | gnl\|Fabrus\|L12__IGKJ1*01 | 820 | 1425 |
| 818 | gnl\|Fabrus\|VH6-1__IGHD7-27*01__IGHJ4*01 | 797 | 1402 | gnl\|Fabrus\|L12__IGKJ1*01 | 820 | 1425 |
| 819 | gnl\|Fabrus\|VH4-59__IGHD6-25*01__IGHJ3*01 | 775 | 1380 | gnl\|Fabrus\|L12__IGKJ1*01 | 820 | 1425 |
| 820 | gnl\|Fabrus\|VH3-48__IGHD6-6*01__IGHJ1*01 | 655 | 1260 | gnl\|Fabrus\|L12__IGKJ1*01 | 820 | 1425 |
| 821 | gnl\|Fabrus\|VH3-30__IGHD6-6*01__IGHJ1*01 | 625 | 1230 | gnl\|Fabrus\|L12__IGKJ1*01 | 820 | 1425 |
| 822 | gnl\|Fabrus\|VH3-66__IGHD6-6*01__IGHJ1*01 | 681 | 1286 | gnl\|Fabrus\|L12__IGKJ1*01 | 820 | 1425 |
| 823 | gnl\|Fabrus\|VH3-53__IGHD5-5*01__IGHJ4*01 | 670 | 1275 | gnl\|Fabrus\|L12__IGKJ1*01 | 820 | 1425 |
| 824 | gnl\|Fabrus\|VH2-5__IGHD5-12*01__IGHJ4*01 | 536 | 1141 | gnl\|Fabrus\|L12__IGKJ1*01 | 820 | 1425 |
| 825 | gnl\|Fabrus\|VH2-70__IGHD5-12*01__IGHJ4*01 | 543 | 1148 | gnl\|Fabrus\|L12__IGKJ1*01 | 820 | 1425 |
| 826 | gnl\|Fabrus\|VH3-15__IGHD5-12*01__IGHJ4*01 | 567 | 1172 | gnl\|Fabrus\|L12__IGKJ1*01 | 820 | 1425 |
| 827 | gnl\|Fabrus\|VH3-15__IGHD3-10*01__IGHJ4*01 | 565 | 1170 | gnl\|Fabrus\|L12__IGKJ1*01 | 820 | 1425 |
| 828 | gnl\|Fabrus\|VH3-49__IGHD5-18*01__IGHJ4*01 | 662 | 1267 | gnl\|Fabrus\|L12__IGKJ1*01 | 820 | 1425 |
| 829 | gnl\|Fabrus\|VH3-49__IGHD6-13*01__IGHJ4*01 | 663 | 1268 | gnl\|Fabrus\|L12__IGKJ1*01 | 820 | 1425 |
| 830 | gnl\|Fabrus\|VH3-72__IGHD5-18*01__IGHJ4*01 | 699 | 1304 | gnl\|Fabrus\|L12__IGKJ1*01 | 820 | 1425 |
| 831 | gnl\|Fabrus\|VH3-72__IGHD6-6*01__IGHJ1*01 | 701 | 1306 | gnl\|Fabrus\|L12__IGKJ1*01 | 820 | 1425 |
| 832 | gnl\|Fabrus\|VH3-73__IGHD5-12*01__IGHJ4*01 | 709 | 1314 | gnl\|Fabrus\|L12__IGKJ1*01 | 820 | 1425 |
| 833 | gnl\|Fabrus\|VH3-73__IGHD4-23*01__IGHJ5*01 | 708 | 1313 | gnl\|Fabrus\|L12__IGKJ1*01 | 820 | 1425 |
| 834 | gnl\|Fabrus\|VH3-43__IGHD3-22*01__IGHJ4*01 | 650 | 1255 | gnl\|Fabrus\|L12__IGKJ1*01 | 820 | 1425 |
| 835 | gnl\|Fabrus\|VH3-43__IGHD6-13*01__IGHJ4*01 | 653 | 1258 | gnl\|Fabrus\|L12__IGKJ1*01 | 820 | 1425 |
| 836 | gnl\|Fabrus\|VH3-9__IGHD3-22*01__IGHJ4*01 | 724 | 1329 | gnl\|Fabrus\|L12__IGKJ1*01 | 820 | 1425 |
| 837 | gnl\|Fabrus\|VH3-9__IGHD1-7*01__IGHJ5*01 | 721 | 1326 | gnl\|Fabrus\|L12__IGKJ1*01 | 820 | 1425 |
| 838 | gnl\|Fabrus\|VH3-9__IGHD6-13*01__IGHJ5*01 | 727 | 1332 | gnl\|Fabrus\|L12__IGKJ1*01 | 820 | 1425 |
| 839 | gnl\|Fabrus\|VH4-39__IGHD3-10*01__IGHJ4*01 | 762 | 1367 | gnl\|Fabrus\|L12__IGKJ1*01 | 820 | 1425 |
| 840 | gnl\|Fabrus\|VH4-39__IGHD5-12*01__IGHJ4*01 | 766 | 1371 | gnl\|Fabrus\|L12__IGKJ1*01 | 820 | 1425 |
| 841 | gnl\|Fabrus\|VH1-18__IGHD6-6*01__IGHJ1*01 | 460 | 1065 | gnl\|Fabrus\|L12__IGKJ1*01 | 820 | 1425 |
| 842 | gnl\|Fabrus\|VH1-24__IGHD5-12*01__IGHJ4*01 | 467 | 1072 | gnl\|Fabrus\|L12__IGKJ1*01 | 820 | 1425 |
| 843 | gnl\|Fabrus\|VH1-2__IGHD1-1*01__IGHJ3*01 | 461 | 1066 | gnl\|Fabrus\|L12__IGKJ1*01 | 820 | 1425 |
| 844 | gnl\|Fabrus\|VH1-3__IGHD6-6*01__IGHJ1*01 | 475 | 1080 | gnl\|Fabrus\|L12__IGKJ1*01 | 820 | 1425 |
| 845 | gnl\|Fabrus\|VH1-45__IGHD3-10*01__IGHJ4*01 | 480 | 1085 | gnl\|Fabrus\|L12__IGKJ1*01 | 820 | 1425 |
| 846 | gnl\|Fabrus\|VH1-46__IGHD1-26*01__IGHJ4*01 | 486 | 1091 | gnl\|Fabrus\|L12__IGKJ1*01 | 820 | 1425 |
| 847 | gnl\|Fabrus\|VH7-81__IGHD2-21*01__IGHJ6*01 | 800 | 1405 | gnl\|Fabrus\|L12__IGKJ1*01 | 820 | 1425 |
| 848 | gnl\|Fabrus\|VH2-70__IGHD3-9*01__IGHJ6*01 | 542 | 1147 | gnl\|Fabrus\|L12__IGKJ1*01 | 820 | 1425 |
| 849 | gnl\|Fabrus\|VH1-58__IGHD3-10*01__IGHJ6*01 | 496 | 1101 | gnl\|Fabrus\|L12__IGKJ1*01 | 820 | 1425 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 850 | gnl\|Fabrus\|VH7-81__IGHD2-21*01__IGHJ*01 | 799 | 1404 | gnl\|Fabrus\|L12__IGKJ1*01 | 820 | 1425 |
| 851 | gnl\|Fabrus\|VH4-28__IGHD3-9*01__IGHJ6*01 | 734 | 1339 | gnl\|Fabrus\|L12__IGKJ1*01 | 820 | 1425 |
| 852 | gnl\|Fabrus\|VH4-31__IGHD2-15*01__IGHJ2*01 | 740 | 1345 | gnl\|Fabrus\|L12__IGKJ1*01 | 820 | 1425 |
| 853 | gnl\|Fabrus\|VH2-5__IGHD3-9*01__IGHJ6*01 | 535 | 1140 | gnl\|Fabrus\|L12__IGKJ1*01 | 820 | 1425 |
| 854 | gnl\|Fabrus\|VH1-8__IGHD2-15*01__IGHJ6*01 | 515 | 1120 | gnl\|Fabrus\|L12__IGKJ1*01 | 820 | 1425 |
| 855 | gnl\|Fabrus\|VH2-70__IGHD2-15*01__IGHJ2*01 | 540 | 1145 | gnl\|Fabrus\|L12__IGKJ1*01 | 820 | 1425 |
| 856 | gnl\|Fabrus\|VH3-38__IGHD3-10*01__IGHJ4*01 | 639 | 1244 | gnl\|Fabrus\|L12__IGKJ1*01 | 820 | 1425 |
| 857 | gnl\|Fabrus\|VH3-16__IGHD1-7*01__IGHJ6*01 | 570 | 1175 | gnl\|Fabrus\|L12__IGKJ1*01 | 820 | 1425 |
| 858 | gnl\|Fabrus\|VH3-73__IGHD3-9*01__IGHJ6*01 | 706 | 1311 | gnl\|Fabrus\|L12__IGKJ1*01 | 820 | 1425 |
| 859 | gnl\|Fabrus\|VH3-11__IGHD3-9*01__IGHJ6*01 | 548 | 1153 | gnl\|Fabrus\|L12__IGKJ1*01 | 820 | 1425 |
| 860 | gnl\|Fabrus\|VH3-11__IGHD6-6*01__IGHJ1*01 | 552 | 1157 | gnl\|Fabrus\|L12__IGKJ1*01 | 820 | 1425 |
| 861 | gnl\|Fabrus\|VH3-20__IGHD5-12*01__IGHJ4*01 | 584 | 1189 | gnl\|Fabrus\|L12__IGKJ1*01 | 820 | 1425 |
| 862 | gnl\|Fabrus\|VH3-16__IGHD2-15*01__IGHJ2*01 | 571 | 1176 | gnl\|Fabrus\|L12__IGKJ1*01 | 820 | 1425 |
| 863 | gnl\|Fabrus\|VH3-7__IGHD6-6*01__IGHJ1*01 | 692 | 1297 | gnl\|Fabrus\|L12__IGKJ1*01 | 820 | 1425 |
| 864 | gnl\|Fabrus\|VH3-16__IGHD6-13*01__IGHJ4*01 | 576 | 1181 | gnl\|Fabrus\|L12__IGKJ1*01 | 820 | 1425 |
| 865 | gnl\|Fabrus\|VH3-23__IGHD1-1*01__IGHJ4*01 | 595 | 1200 | gnl\|Fabrus\|O1__IGKJ1*01 | 832 | 1437 |
| 866 | gnl\|Fabrus\|VH3-23__IGHD2-15*01__IGHJ4*01 | 598 | 1203 | gnl\|Fabrus\|O1__IGKJ1*01 | 832 | 1437 |
| 867 | gnl\|Fabrus\|VH3-23__IGHD3-22*01__IGHJ4*01 | 602 | 1207 | gnl\|Fabrus\|O1__IGKJ1*01 | 832 | 1437 |
| 868 | gnl\|Fabrus\|VH3-23__IGHD4-11*01__IGHJ4*01 | 604 | 1209 | gnl\|Fabrus\|O1__IGKJ1*01 | 832 | 1437 |
| 869 | gnl\|Fabrus\|VH3-23__IGHD5-12*01__IGHJ4*01 | 606 | 1211 | gnl\|Fabrus\|O1__IGKJ1*01 | 832 | 1437 |
| 870 | gnl\|Fabrus\|VH3-23__IGHD5-5*01__IGHJ4*01 | 608 | 1213 | gnl\|Fabrus\|O1__IGKJ1*01 | 832 | 1437 |
| 871 | gnl\|Fabrus\|VH3-23__IGHD6-13*01__IGHJ4*01 | 609 | 1214 | gnl\|Fabrus\|O1__IGKJ1*01 | 832 | 1437 |
| 872 | gnl\|Fabrus\|VH3-23__IGHD7-27*01__IGHJ4*01 | 612 | 1217 | gnl\|Fabrus\|O1__IGKJ1*01 | 832 | 1437 |
| 873 | gnl\|Fabrus\|VH3-23__IGHD7-27*01__IGHJ6*01 | 613 | 1218 | gnl\|Fabrus\|O1__IGKJ1*01 | 832 | 1437 |
| 874 | gnl\|Fabrus\|VH1-69__IGHD1-14*01__IGHJ4*01 | 502 | 1107 | gnl\|Fabrus\|O1__IGKJ1*01 | 832 | 1437 |
| 875 | gnl\|Fabrus\|VH1-69__IGHD2-2*01__IGHJ4*01 | 503 | 1108 | gnl\|Fabrus\|O1__IGKJ1*01 | 832 | 1437 |
| 876 | gnl\|Fabrus\|VH1-69__IGHD2-8*01__IGHJ6*01 | 504 | 1109 | gnl\|Fabrus\|O1__IGKJ1*01 | 832 | 1437 |
| 877 | gnl\|Fabrus\|VH1-69__IGHD3-16*01__IGHJ4*01 | 505 | 1110 | gnl\|Fabrus\|O1__IGKJ1*01 | 832 | 1437 |
| 878 | gnl\|Fabrus\|VH1-69__IGHD3-3*01__IGHJ4*01 | 506 | 1111 | gnl\|Fabrus\|O1__IGKJ1*01 | 832 | 1437 |
| 879 | gnl\|Fabrus\|VH1-69__IGHD4-17*01__IGHJ4*01 | 508 | 1113 | gnl\|Fabrus\|O1__IGKJ1*01 | 832 | 1437 |
| 880 | gnl\|Fabrus\|VH1-69__IGHD5-12*01__IGHJ4*01 | 509 | 1114 | gnl\|Fabrus\|O1__IGKJ1*01 | 832 | 1437 |
| 881 | gnl\|Fabrus\|VH1-69__IGHD6-19*01__IGHJ4*01 | 511 | 1116 | gnl\|Fabrus\|O1__IGKJ1*01 | 832 | 1437 |
| 882 | gnl\|Fabrus\|VH1-69__IGHD7-27*01__IGHJ4*01 | 513 | 1118 | gnl\|Fabrus\|O1__IGKJ1*01 | 832 | 1437 |
| 883 | gnl\|Fabrus\|VH4-34__IGHD1-7*01__IGHJ4*01 | 749 | 1354 | gnl\|Fabrus\|O1__IGKJ1*01 | 832 | 1437 |
| 884 | gnl\|Fabrus\|VH4-34__IGHD2-2*01__IGHJ4*01 | 750 | 1355 | gnl\|Fabrus\|O1__IGKJ1*01 | 832 | 1437 |
| 885 | gnl\|Fabrus\|VH4-34__IGHD3-16*01__IGHJ4*01 | 751 | 1356 | gnl\|Fabrus\|O1__IGKJ1*01 | 832 | 1437 |
| 886 | gnl\|Fabrus\|VH4-34__IGHD4-17*01__IGHJ4*01 | 753 | 1358 | gnl\|Fabrus\|O1__IGKJ1*01 | 832 | 1437 |
| 887 | gnl\|Fabrus\|VH4-34__IGHD5-12*01__IGHJ4*01 | 754 | 1359 | gnl\|Fabrus\|O1__IGKJ1*01 | 832 | 1437 |
| 888 | gnl\|Fabrus\|VH4-34__IGHD6-13*01__IGHJ4*01 | 755 | 1360 | gnl\|Fabrus\|O1__IGKJ1*01 | 832 | 1437 |
| 889 | gnl\|Fabrus\|VH4-34__IGHD6-25*01__IGHJ6*01 | 756 | 1361 | gnl\|Fabrus\|O1__IGKJ1*01 | 832 | 1437 |
| 890 | gnl\|Fabrus\|VH4-34__IGHD7-27*01__IGHJ4*01 | 758 | 1363 | gnl\|Fabrus\|O1__IGKJ1*01 | 832 | 1437 |
| 891 | gnl\|Fabrus\|VH2-26__IGHD1-20*01__IGHJ4*01 | 521 | 1126 | gnl\|Fabrus\|O1__IGKJ1*01 | 832 | 1437 |
| 892 | gnl\|Fabrus\|VH2-26__IGHD2-2*01__IGHJ4*01 | 523 | 1128 | gnl\|Fabrus\|O1__IGKJ1*01 | 832 | 1437 |
| 893 | gnl\|Fabrus\|VH2-26__IGHD3-10*01__IGHJ4*01 | 524 | 1129 | gnl\|Fabrus\|O1__IGKJ1*01 | 832 | 1437 |
| 894 | gnl\|Fabrus\|VH2-26__IGHD4-11*01__IGHJ4*01 | 526 | 1131 | gnl\|Fabrus\|O1__IGKJ1*01 | 832 | 1437 |
| 895 | gnl\|Fabrus\|VH2-26__IGHD5-18*01__IGHJ4*01 | 528 | 1133 | gnl\|Fabrus\|O1__IGKJ1*01 | 832 | 1437 |
| 896 | gnl\|Fabrus\|VH2-26__IGHD6-13*01__IGHJ4*01 | 529 | 1134 | gnl\|Fabrus\|O1__IGKJ1*01 | 832 | 1437 |
| 897 | gnl\|Fabrus\|VH2-26__IGHD7-27*01__IGHJ4*01 | 530 | 1135 | gnl\|Fabrus\|O1__IGKJ1*01 | 832 | 1437 |
| 898 | gnl\|Fabrus\|VH5-51__IGHD1-14*01__IGHJ4*01 | 776 | 1381 | gnl\|Fabrus\|O1__IGKJ1*01 | 832 | 1437 |
| 899 | gnl\|Fabrus\|VH5-51__IGHD2-8*01__IGHJ4*01 | 778 | 1383 | gnl\|Fabrus\|O1__IGKJ1*01 | 832 | 1437 |
| 900 | gnl\|Fabrus\|VH5-51__IGHD3-3*01__IGHJ4*01 | 780 | 1385 | gnl\|Fabrus\|O1__IGKJ1*01 | 832 | 1437 |
| 901 | gnl\|Fabrus\|VH5-51__IGHD4-17*01__IGHJ4*01 | 781 | 1386 | gnl\|Fabrus\|O1__IGKJ1*01 | 832 | 1437 |
| 902 | gnl\|Fabrus\|VH5-51__IGHD5-18*01>3__IGHJ4*01 | 782 | 1387 | gnl\|Fabrus\|O1__IGKJ1*01 | 832 | 1437 |
| 903 | gnl\|Fabrus\|VH5-51__IGHD5-18*01>1__IGHJ4*01 | 783 | 1388 | gnl\|Fabrus\|O1__IGKJ1*01 | 832 | 1437 |
| 904 | gnl\|Fabrus\|VH5-51__IGHD6-25*01__IGHJ4*01 | 784 | 1389 | gnl\|Fabrus\|O1__IGKJ1*01 | 832 | 1437 |
| 905 | gnl\|Fabrus\|VH5-51__IGHD7-27*01__IGHJ4*01 | 785 | 1390 | gnl\|Fabrus\|O1__IGKJ1*01 | 832 | 1437 |
| 906 | gnl\|Fabrus\|VH6-1__IGHD1-1*01__IGHJ4*01 | 786 | 1391 | gnl\|Fabrus\|O1__IGKJ1*01 | 832 | 1437 |
| 907 | gnl\|Fabrus\|VH6-1__IGHD2-15*01__IGHJ4*01 | 788 | 1393 | gnl\|Fabrus\|O1__IGKJ1*01 | 832 | 1437 |
| 908 | gnl\|Fabrus\|VH6-1__IGHD3-3*01__IGHJ4*01 | 791 | 1396 | gnl\|Fabrus\|O1__IGKJ1*01 | 832 | 1437 |
| 909 | gnl\|Fabrus\|VH6-1__IGHD4-23*01__IGHJ4*01 | 793 | 1398 | gnl\|Fabrus\|O1__IGKJ1*01 | 832 | 1437 |
| 910 | gnl\|Fabrus\|VH6-1__IGHD4-11*01__IGHJ6*01 | 792 | 1397 | gnl\|Fabrus\|O1__IGKJ1*01 | 832 | 1437 |
| 911 | gnl\|Fabrus\|VH6-1__IGHD5-5*01__IGHJ4*01 | 794 | 1399 | gnl\|Fabrus\|O1__IGKJ1*01 | 832 | 1437 |
| 912 | gnl\|Fabrus\|VH6-1__IGHD6-13*01__IGHJ4*01 | 795 | 1400 | gnl\|Fabrus\|O1__IGKJ1*01 | 832 | 1437 |
| 913 | gnl\|Fabrus\|VH6-1__IGHD6-25*01__IGHJ6*01 | 796 | 1401 | gnl\|Fabrus\|O1__IGKJ1*01 | 832 | 1437 |
| 914 | gnl\|Fabrus\|VH6-1__IGHD7-27*01__IGHJ4*01 | 797 | 1402 | gnl\|Fabrus\|O1__IGKJ1*01 | 832 | 1437 |
| 915 | gnl\|Fabrus\|VH4-59__IGHD6-25*01__IGHJ3*01 | 775 | 1380 | gnl\|Fabrus\|O1__IGKJ1*01 | 832 | 1437 |
| 916 | gnl\|Fabrus\|VH3-48__IGHD6-6*01__IGHJ1*01 | 655 | 1260 | gnl\|Fabrus\|O1__IGKJ1*01 | 832 | 1437 |
| 917 | gnl\|Fabrus\|VH3-30__IGHD6-6*01__IGHJ1*01 | 625 | 1230 | gnl\|Fabrus\|O1__IGKJ1*01 | 832 | 1437 |
| 918 | gnl\|Fabrus\|VH3-86__IGHD6-6*01__IGHJ1*01 | 681 | 1286 | gnl\|Fabrus\|O1__IGKJ1*01 | 832 | 1437 |
| 919 | gnl\|Fabrus\|VH3-53__IGHD5-5*01__IGHJ4*01 | 670 | 1275 | gnl\|Fabrus\|O1__IGKJ1*01 | 832 | 1437 |
| 920 | gnl\|Fabrus\|VH2-5__IGHD5-12*01__IGHJ4*01 | 536 | 1141 | gnl\|Fabrus\|O1__IGKJ1*01 | 832 | 1437 |
| 921 | gnl\|Fabrus\|VH2-70__IGHD5-12*01__IGHJ4*01 | 543 | 1148 | gnl\|Fabrus\|O1__IGKJ1*01 | 832 | 1437 |
| 922 | gnl\|Fabrus\|VH3-15__IGHD5-12*01__IGHJ4*01 | 567 | 1172 | gnl\|Fabrus\|O1__IGKJ1*01 | 832 | 1437 |
| 923 | gnl\|Fabrus\|VH3-15__IGHD3-10*01__IGHJ4*01 | 565 | 1170 | gnl\|Fabrus\|O1__IGKJ1*01 | 832 | 1437 |
| 924 | gnl\|Fabrus\|VH3-49__IGHD5-18*01__IGHJ4*01 | 662 | 1267 | gnl\|Fabrus\|O1__IGKJ1*01 | 832 | 1437 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 925 | gnl\|Fabrus\|VH3-49__IGHD6-13*01__IGHJ4*01 | 663 | 1268 | gnl\|Fabrus\|O1__IGKJ1*01 | 832 | 1437 |
| 926 | gnl\|Fabrus\|VH3-72__IGHD5-18*01__IGHJ4*01 | 699 | 1304 | gnl\|Fabrus\|O1__IGKJ1*01 | 832 | 1437 |
| 927 | gnl\|Fabrus\|VH3-72__IGHD6-6*01__IGHJ1*01 | 701 | 1306 | gnl\|Fabrus\|O1__IGKJ1*01 | 832 | 1437 |
| 928 | gnl\|Fabrus\|VH3-73__IGHD5-12*01__IGHJ4*01 | 709 | 1314 | gnl\|Fabrus\|O1__IGKJ1*01 | 832 | 1437 |
| 929 | gnl\|Fabrus\|VH3-73__IGHD4-23*01__IGHJ5*01 | 708 | 1313 | gnl\|Fabrus\|O1__IGKJ1*01 | 832 | 1437 |
| 930 | gnl\|Fabrus\|VH3-43__IGHD3-22*01__IGHJ4*01 | 650 | 1255 | gnl\|Fabrus\|O1__IGKJ1*01 | 832 | 1437 |
| 931 | gnl\|Fabrus\|VH3-43__IGHD6-13*01__IGHJ4*01 | 653 | 1258 | gnl\|Fabrus\|O1__IGKJ1*01 | 832 | 1437 |
| 932 | gnl\|Fabrus\|VH3-9__IGHD3-22*01__IGHJ4*01 | 724 | 1329 | gnl\|Fabrus\|O1__IGKJ1*01 | 832 | 1437 |
| 933 | gnl\|Fabrus\|VH3-9__IGHD1-7*01__IGHJ5*01 | 721 | 1326 | gnl\|Fabrus\|O1__IGKJ1*01 | 832 | 1437 |
| 934 | gnl\|Fabrus\|VH3-9__IGHD6-13*01__IGHJ4*01 | 727 | 1332 | gnl\|Fabrus\|O1__IGKJ1*01 | 832 | 1437 |
| 935 | gnl\|Fabrus\|VH4-39__IGHD3-10*01__IGHJ4*01 | 762 | 1367 | gnl\|Fabrus\|O1__IGKJ1*01 | 832 | 1437 |
| 936 | gnl\|Fabrus\|VH4-39__IGHD5-12*01__IGHJ4*01 | 766 | 1371 | gnl\|Fabrus\|O1__IGKJ1*01 | 832 | 1437 |
| 937 | gnl\|Fabrus\|VH1-18__IGHD6-6*01__IGHJ1*01 | 460 | 1065 | gnl\|Fabrus\|O1__IGKJ1*01 | 832 | 1437 |
| 938 | gnl\|Fabrus\|VH1-24__IGHD5-12*01__IGHJ4*01 | 467 | 1072 | gnl\|Fabrus\|O1__IGKJ1*01 | 832 | 1437 |
| 939 | gnl\|Fabrus\|VH1-2__IGHD1-1*01__IGHJ3*01 | 461 | 1066 | gnl\|Fabrus\|O1__IGKJ1*01 | 832 | 1437 |
| 940 | gnl\|Fabrus\|VH1-3__IGHD6-6*01__IGHJ1*01 | 475 | 1080 | gnl\|Fabrus\|O1__IGKJ1*01 | 832 | 1437 |
| 941 | gnl\|Fabrus\|VH1-45__IGHD3-10*01__IGHJ4*01 | 480 | 1085 | gnl\|Fabrus\|O1__IGKJ1*01 | 832 | 1437 |
| 942 | gnl\|Fabrus\|VH1-46__IGHD1-26*01__IGHJ4*01 | 486 | 1091 | gnl\|Fabrus\|O1__IGKJ1*01 | 832 | 1437 |
| 943 | gnl\|Fabrus\|VH7-81__IGHD2-21*01__IGHJ6*01 | 800 | 1405 | gnl\|Fabrus\|O1__IGKJ1*01 | 832 | 1437 |
| 944 | gnl\|Fabrus\|VH2-70__IGHD3-9*01__IGHJ6*01 | 542 | 1147 | gnl\|Fabrus\|O1__IGKJ1*01 | 832 | 1437 |
| 945 | gnl\|Fabrus\|VH1-58__IGHD3-10*01__IGHJ6*01 | 496 | 1101 | gnl\|Fabrus\|O1__IGKJ1*01 | 832 | 1437 |
| 946 | gnl\|Fabrus\|VH7-81__IGHD2-21*01__IGHJ2*01 | 799 | 1404 | gnl\|Fabrus\|O1__IGKJ1*01 | 832 | 1437 |
| 947 | gnl\|Fabrus\|VH4-28__IGHD3-9*01__IGHJ6*01 | 734 | 1339 | gnl\|Fabrus\|O1__IGKJ1*01 | 832 | 1437 |
| 948 | gnl\|Fabrus\|VH4-31__IGHD2-15*01__IGHJ2*01 | 740 | 1345 | gnl\|Fabrus\|O1__IGKJ1*01 | 832 | 1437 |
| 949 | gnl\|Fabrus\|VH2-5__IGHD3-9*01__IGHJ6*01 | 535 | 1140 | gnl\|Fabrus\|O1__IGKJ1*01 | 832 | 1437 |
| 950 | gnl\|Fabrus\|VH1-8__IGHD2-15*01__IGHJ6*01 | 515 | 1120 | gnl\|Fabrus\|O1__IGKJ1*01 | 832 | 1437 |
| 951 | gnl\|Fabrus\|VH2-70__IGHD2-15*01__IGHJ2*01 | 540 | 1145 | gnl\|Fabrus\|O1__IGKJ1*01 | 832 | 1437 |
| 952 | gnl\|Fabrus\|VH3-38__IGHD3-10*01__IGHJ4*01 | 639 | 1244 | gnl\|Fabrus\|O1__IGKJ1*01 | 832 | 1437 |
| 953 | gnl\|Fabrus\|VH3-16__IGHD1-7*01__IGHJ6*01 | 570 | 1175 | gnl\|Fabrus\|O1__IGKJ1*01 | 832 | 1437 |
| 954 | gnl\|Fabrus\|VH3-73__IGHD3-9*01__IGHJ6*01 | 706 | 1311 | gnl\|Fabrus\|O1__IGKJ1*01 | 832 | 1437 |
| 955 | gnl\|Fabrus\|VH3-11__IGHD3-9*01__IGHJ6*01 | 548 | 1153 | gnl\|Fabrus\|O1__IGKJ1*01 | 832 | 1437 |
| 956 | gnl\|Fabrus\|VH3-11__IGHD6-6*01__IGHJ1*01 | 552 | 1157 | gnl\|Fabrus\|O1__IGKJ1*01 | 832 | 1437 |
| 957 | gnl\|Fabrus\|VH3-20__IGHD5-12*01__IGHJ4*01 | 584 | 1189 | gnl\|Fabrus\|O1__IGKJ1*01 | 832 | 1437 |
| 958 | gnl\|Fabrus\|VH3-16__IGHD2-15*01__IGHJ2*01 | 571 | 1176 | gnl\|Fabrus\|O1__IGKJ1*01 | 832 | 1437 |
| 959 | gnl\|Fabrus\|VH3-7__IGHD6-6*01__IGHJ1*01 | 692 | 1297 | gnl\|Fabrus\|O1__IGKJ1*01 | 832 | 1437 |
| 960 | gnl\|Fabrus\|VH3-16__IGHD6-13*01__IGHJ4*01 | 576 | 1181 | gnl\|Fabrus\|O1__IGKJ1*01 | 832 | 1437 |
| 961 | gnl\|Fabrus\|VH3-23__IGHD1-1*01__IGHJ4*01 | 595 | 1200 | gnl\|Fabrus\|L25__IGKJ3*01 | 826 | 1431 |
| 962 | gnl\|Fabrus\|VH3-23__IGHD2-15*01__IGHJ4*01 | 598 | 1203 | gnl\|Fabrus\|L25__IGKJ3*01 | 826 | 1431 |
| 963 | gnl\|Fabrus\|VH3-23__IGHD3-22*01__IGHJ4*01 | 602 | 1207 | gnl\|Fabrus\|L25__IGKJ3*01 | 826 | 1431 |
| 964 | gnl\|Fabrus\|VH3-23__IGHD4-11*01__IGHJ4*01 | 604 | 1209 | gnl\|Fabrus\|L25__IGKJ3*01 | 826 | 1431 |
| 965 | gnl\|Fabrus\|VH3-23__IGHD5-12*01__IGHJ4*01 | 606 | 1211 | gnl\|Fabrus\|L25__IGKJ3*01 | 826 | 1431 |
| 966 | gnl\|Fabrus\|VH3-23__IGHD5-5*01__IGHJ4*01 | 608 | 1213 | gnl\|Fabrus\|L25__IGKJ3*01 | 826 | 1431 |
| 967 | gnl\|Fabrus\|VH3-23__IGHD6-13*01__IGHJ4*01 | 609 | 1214 | gnl\|Fabrus\|L25__IGKJ3*01 | 826 | 1431 |
| 968 | gnl\|Fabrus\|VH3-23__IGHD7-27*01__IGHJ4*01 | 612 | 1217 | gnl\|Fabrus\|L25__IGKJ3*01 | 826 | 1431 |
| 969 | gnl\|Fabrus\|VH3-23__IGHD7-27*01__IGHJ6*01 | 613 | 1218 | gnl\|Fabrus\|L25__IGKJ3*01 | 826 | 1431 |
| 970 | gnl\|Fabrus\|VH1-69__IGHD1-14*01__IGHJ4*01 | 502 | 1107 | gnl\|Fabrus\|L25__IGKJ3*01 | 826 | 1431 |
| 971 | gnl\|Fabrus\|VH1-69__IGHD2-2*01__IGHJ4*01 | 503 | 1108 | gnl\|Fabrus\|L25__IGKJ3*01 | 826 | 1431 |
| 972 | gnl\|Fabrus\|VH1-69__IGHD2-8*01__IGHJ6*01 | 504 | 1109 | gnl\|Fabrus\|L25__IGKJ3*01 | 826 | 1431 |
| 973 | gnl\|Fabrus\|VH1-69__IGHD3-16*01__IGHJ4*01 | 505 | 1110 | gnl\|Fabrus\|L25__IGKJ3*01 | 826 | 1431 |
| 974 | gnl\|Fabrus\|VH1-69__IGHD3-3*01__IGHJ4*01 | 506 | 1111 | gnl\|Fabrus\|L25__IGKJ3*01 | 826 | 1431 |
| 975 | gnl\|Fabrus\|VH1-69__IGHD4-17*01__IGHJ4*01 | 508 | 1113 | gnl\|Fabrus\|L25__IGKJ3*01 | 826 | 1431 |
| 976 | gnl\|Fabrus\|VH1-69__IGHD5-12*01__IGHJ4*01 | 509 | 1114 | gnl\|Fabrus\|L25__IGKJ3*01 | 826 | 1431 |
| 977 | gnl\|Fabrus\|VH1-69__IGHD6-19*01__IGHJ4*01 | 511 | 1116 | gnl\|Fabrus\|L25__IGKJ3*01 | 826 | 1431 |
| 978 | gnl\|Fabrus\|VH1-69__IGHD7-27*01__IGHJ4*01 | 513 | 1118 | gnl\|Fabrus\|L25__IGKJ3*01 | 826 | 1431 |
| 979 | gnl\|Fabrus\|VH4-34__IGHD1-7*01__IGHJ4*01 | 749 | 1354 | gnl\|Fabrus\|L25__IGKJ3*01 | 826 | 1431 |
| 980 | gnl\|Fabrus\|VH4-34__IGHD2-2*01__IGHJ4*01 | 750 | 1355 | gnl\|Fabrus\|L25__IGKJ3*01 | 826 | 1431 |
| 981 | gnl\|Fabrus\|VH4-34__IGHD3-16*01__IGHJ4*01 | 751 | 1356 | gnl\|Fabrus\|L25__IGKJ3*01 | 826 | 1431 |
| 982 | gnl\|Fabrus\|VH4-34__IGHD4-17*01__IGHJ4*01 | 753 | 1358 | gnl\|Fabrus\|L25__IGKJ3*01 | 826 | 1431 |
| 983 | gnl\|Fabrus\|VH4-34__IGHD5-12*01__IGHJ4*01 | 754 | 1359 | gnl\|Fabrus\|L25__IGKJ3*01 | 826 | 1431 |
| 984 | gnl\|Fabrus\|VH4-34__IGHD6-13*01__IGHJ4*01 | 755 | 1360 | gnl\|Fabrus\|L25__IGKJ3*01 | 826 | 1431 |
| 985 | gnl\|Fabrus\|VH4-34__IGHD6-25*01__IGHJ6*01 | 756 | 1361 | gnl\|Fabrus\|L25__IGKJ3*01 | 826 | 1431 |
| 986 | gnl\|Fabrus\|VH4-34__IGHD7-27*01__IGHJ4*01 | 758 | 1363 | gnl\|Fabrus\|L25__IGKJ3*01 | 826 | 1431 |
| 987 | gnl\|Fabrus\|VH2-26__IGHD1-20*01__IGHJ4*01 | 521 | 1126 | gnl\|Fabrus\|L25__IGKJ3*01 | 826 | 1431 |
| 988 | gnl\|Fabrus\|VH2-26__IGHD2-2*01__IGHJ4*01 | 523 | 1128 | gnl\|Fabrus\|L25__IGKJ3*01 | 826 | 1431 |
| 989 | gnl\|Fabrus\|VH2-26__IGHD3-10*01__IGHJ4*01 | 524 | 1129 | gnl\|Fabrus\|L25__IGKJ3*01 | 826 | 1431 |
| 990 | gnl\|Fabrus\|VH2-26__IGHD4-11*01__IGHJ4*01 | 526 | 1131 | gnl\|Fabrus\|L25__IGKJ3*01 | 826 | 1431 |
| 991 | gnl\|Fabrus\|VH2-26__IGHD5-18*01__IGHJ4*01 | 528 | 1133 | gnl\|Fabrus\|L25__IGKJ3*01 | 826 | 1431 |
| 992 | gnl\|Fabrus\|VH2-26__IGHD6-13*01__IGHJ4*01 | 529 | 1134 | gnl\|Fabrus\|L25__IGKJ3*01 | 826 | 1431 |
| 993 | gnl\|Fabrus\|VH2-26__IGHD7-27*01__IGHJ4*01 | 530 | 1135 | gnl\|Fabrus\|L25__IGKJ3*01 | 826 | 1431 |
| 994 | gnl\|Fabrus\|VH5-51__IGHD1-14*01__IGHJ4*01 | 776 | 1381 | gnl\|Fabrus\|L25__IGKJ3*01 | 826 | 1431 |
| 995 | gnl\|Fabrus\|VH5-51__IGHD2-8*01__IGHJ4*01 | 778 | 1383 | gnl\|Fabrus\|L25__IGKJ3*01 | 826 | 1431 |
| 996 | gnl\|Fabrus\|VH5-51__IGHD3-3*01__IGHJ4*01 | 780 | 1385 | gnl\|Fabrus\|L25__IGKJ3*01 | 826 | 1431 |
| 997 | gnl\|Fabrus\|VH5-51__IGHD4-17*01__IGHJ4*01 | 781 | 1386 | gnl\|Fabrus\|L25__IGKJ3*01 | 826 | 1431 |
| 998 | gnl\|Fabrus\|VH5-51__IGHD5-18*01>3__IGHJ4*01 | 782 | 1387 | gnl\|Fabrus\|L25__IGKJ3*01 | 826 | 1431 |
| 999 | gnl\|Fabrus\|VH5-51__IGHD5-18*01>1__IGHJ4*01 | 783 | 1388 | gnl\|Fabrus\|L25__IGKJ3*01 | 826 | 1431 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 1000 | gnl\|Fabrus\|VH5-51__IGHD6-25*01__IGHJ4*01 | 784 | 1389 | gnl\|Fabrus\|L25__IGKJ3*01 | 826 | 1431 |
| 1001 | gnl\|Fabrus\|VH5-51__IGHD7-27*01__IGHJ4*01 | 785 | 1390 | gnl\|Fabrus\|L25__IGKJ3*01 | 826 | 1431 |
| 1002 | gnl\|Fabrus\|VH6-1__IGHD1-1*01__IGHJ4*01 | 786 | 1391 | gnl\|Fabrus\|L25__IGKJ3*01 | 826 | 1431 |
| 1003 | gnl\|Fabrus\|VH6-1__IGHD2-15*01__IGHJ4*01 | 788 | 1393 | gnl\|Fabrus\|L25__IGKJ3*01 | 826 | 1431 |
| 1004 | gnl\|Fabrus\|VH6-1__IGHD3-3*01__IGHJ4*01 | 791 | 1396 | gnl\|Fabrus\|L25__IGKJ3*01 | 826 | 1431 |
| 1005 | gnl\|Fabrus\|VH6-1__IGHD4-23*01__IGHJ4*01 | 793 | 1398 | gnl\|Fabrus\|L25__IGKJ3*01 | 826 | 1431 |
| 1006 | gnl\|Fabrus\|VH6-1__IGHD4-11*01__IGHJ6*01 | 792 | 1397 | gnl\|Fabrus\|L25__IGKJ3*01 | 826 | 1431 |
| 1007 | gnl\|Fabrus\|VH6-1__IGHD5-5*01__IGHJ4*01 | 794 | 1399 | gnl\|Fabrus\|L25__IGKJ3*01 | 826 | 1431 |
| 1008 | gnl\|Fabrus\|VH6-1__IGHD6-13*01__IGHJ4*01 | 795 | 1400 | gnl\|Fabrus\|L25__IGKJ3*01 | 826 | 1431 |
| 1009 | gnl\|Fabrus\|VH6-1__IGHD6-25*01__IGHJ6*01 | 796 | 1401 | gnl\|Fabrus\|L25__IGKJ3*01 | 826 | 1431 |
| 1010 | gnl\|Fabrus\|VH6-1__IGHD7-27*01__IGHJ4*01 | 797 | 1402 | gnl\|Fabrus\|L25__IGKJ3*01 | 826 | 1431 |
| 1011 | gnl\|Fabrus\|VH4-59__IGHD6-25*01__IGHJ3*01 | 775 | 1380 | gnl\|Fabrus\|L25__IGKJ3*01 | 826 | 1431 |
| 1012 | gnl\|Fabrus\|VH3-48__IGHD6-6*01__IGHJ1*01 | 655 | 1260 | gnl\|Fabrus\|L25__IGKJ3*01 | 826 | 1431 |
| 1013 | gnl\|Fabrus\|VH3-30__IGHD6-6*01__IGHJ1*01 | 625 | 1230 | gnl\|Fabrus\|L25__IGKJ3*01 | 826 | 1431 |
| 1014 | gnl\|Fabrus\|VH3-66__IGHD6-6*01__IGHJ1*01 | 681 | 1286 | gnl\|Fabrus\|L25__IGKJ3*01 | 826 | 1431 |
| 1015 | gnl\|Fabrus\|VH3-53__IGHD5-5*01__IGHJ4*01 | 670 | 1275 | gnl\|Fabrus\|L25__IGKJ3*01 | 826 | 1431 |
| 1016 | gnl\|Fabrus\|VH2-5__IGHD5-12*01__IGHJ4*01 | 536 | 1141 | gnl\|Fabrus\|L25__IGKJ3*01 | 826 | 1431 |
| 1017 | gnl\|Fabrus\|VH2-70__IGHD5-12*01__IGHJ4*01 | 543 | 1148 | gnl\|Fabrus\|L25__IGKJ3*01 | 826 | 1431 |
| 1018 | gnl\|Fabrus\|VH3-15__IGHD5-12*01__IGHJ4*01 | 567 | 1172 | gnl\|Fabrus\|L25__IGKJ3*01 | 826 | 1431 |
| 1019 | gnl\|Fabrus\|VH3-15__IGHD3-10*01__IGHJ4*01 | 565 | 1170 | gnl\|Fabrus\|L25__IGKJ3*01 | 826 | 1431 |
| 1020 | gnl\|Fabrus\|VH3-49__IGHD5-18*01__IGHJ4*01 | 662 | 1267 | gnl\|Fabrus\|L25__IGKJ3*01 | 826 | 1431 |
| 1021 | gnl\|Fabrus\|VH3-49__IGHD6-13*01__IGHJ4*01 | 663 | 1268 | gnl\|Fabrus\|L25__IGKJ3*01 | 826 | 1431 |
| 1022 | gnl\|Fabrus\|VH3-72__IGHD5-18*01__IGHJ4*01 | 699 | 1304 | gnl\|Fabrus\|L25__IGKJ3*01 | 826 | 1431 |
| 1023 | gnl\|Fabrus\|VH3-72__IGHD6-6*01__IGHJ1*01 | 701 | 1306 | gnl\|Fabrus\|L25__IGKJ3*01 | 826 | 1431 |
| 1024 | gnl\|Fabrus\|VH3-73__IGHD5-12*01__IGHJ4*01 | 709 | 1314 | gnl\|Fabrus\|L25__IGKJ3*01 | 826 | 1431 |
| 1025 | gnl\|Fabrus\|VH3-73__IGHD4-23*01__IGHJ5*01 | 708 | 1313 | gnl\|Fabrus\|L25__IGKJ3*01 | 826 | 1431 |
| 1026 | gnl\|Fabrus\|VH3-43__IGHD3-22*01__IGHJ4*01 | 650 | 1255 | gnl\|Fabrus\|L25__IGKJ3*01 | 826 | 1431 |
| 1027 | gnl\|Fabrus\|VH3-43__IGHD6-13*01__IGHJ4*01 | 653 | 1258 | gnl\|Fabrus\|L25__IGKJ3*01 | 826 | 1431 |
| 1028 | gnl\|Fabrus\|VH3-9__IGHD3-22*01__IGHJ4*01 | 724 | 1329 | gnl\|Fabrus\|L25__IGKJ3*01 | 826 | 1431 |
| 1029 | gnl\|Fabrus\|VH3-9__IGHD1-7*01__IGHJ5*01 | 721 | 1326 | gnl\|Fabrus\|L25__IGKJ3*01 | 826 | 1431 |
| 1030 | gnl\|Fabrus\|VH3-9__IGHD6-13*01__IGHJ4*01 | 727 | 1332 | gnl\|Fabrus\|L25__IGKJ3*01 | 826 | 1431 |
| 1031 | gnl\|Fabrus\|VH4-39__IGHD3-10*01__IGHJ4*01 | 762 | 1367 | gnl\|Fabrus\|L25__IGKJ3*01 | 826 | 1431 |
| 1032 | gnl\|Fabrus\|VH4-39__IGHD5-12*01__IGHJ4*01 | 766 | 1371 | gnl\|Fabrus\|L25__IGKJ3*01 | 826 | 1431 |
| 1033 | gnl\|Fabrus\|VH1-18__IGHD6-6*01__IGHJ1*01 | 460 | 1065 | gnl\|Fabrus\|L25__IGKJ3*01 | 826 | 1431 |
| 1034 | gnl\|Fabrus\|VH1-24__IGHD5-12*01__IGHJ4*01 | 467 | 1072 | gnl\|Fabrus\|L25__IGKJ3*01 | 826 | 1431 |
| 1035 | gnl\|Fabrus\|VH1-2__IGHD1-1*01__IGHJ3*01 | 461 | 1066 | gnl\|Fabrus\|L25__IGKJ3*01 | 826 | 1431 |
| 1036 | gnl\|Fabrus\|VH1-3__IGHD6-6*01__IGHJ1*01 | 475 | 1080 | gnl\|Fabrus\|L25__IGKJ3*01 | 826 | 1431 |
| 1037 | gnl\|Fabrus\|VH1-45__IGHD3-10*01__IGHJ4*01 | 480 | 1085 | gnl\|Fabrus\|L25__IGKJ3*01 | 826 | 1431 |
| 1038 | gnl\|Fabrus\|VH1-46__IGHD1-26*01__IGHJ4*01 | 486 | 1091 | gnl\|Fabrus\|L25__IGKJ3*01 | 826 | 1431 |
| 1039 | gnl\|Fabrus\|VH7-81__IGHD2-21*01__IGHJ6*01 | 800 | 1405 | gnl\|Fabrus\|L25__IGKJ3*01 | 826 | 1431 |
| 1040 | gnl\|Fabrus\|VH2-70__IGHD3-9*01__IGHJ6*01 | 542 | 1147 | gnl\|Fabrus\|L25__IGKJ3*01 | 826 | 1431 |
| 1041 | gnl\|Fabrus\|VH1-58__IGHD3-10*01__IGHJ6*01 | 496 | 1101 | gnl\|Fabrus\|L25__IGKJ3*01 | 826 | 1431 |
| 1042 | gnl\|Fabrus\|VH7-81__IGHD2-21*01__IGHJ2*01 | 799 | 1404 | gnl\|Fabrus\|L25__IGKJ3*01 | 826 | 1431 |
| 1043 | gnl\|Fabrus\|VH4-28__IGHD3-9*01__IGHJ6*01 | 734 | 1339 | gnl\|Fabrus\|L25__IGKJ3*01 | 826 | 1431 |
| 1044 | gnl\|Fabrus\|VH4-31__IGHD2-15*01__IGHJ2*01 | 740 | 1345 | gnl\|Fabrus\|L25__IGKJ3*01 | 826 | 1431 |
| 1045 | gnl\|Fabrus\|VH2-5__IGHD3-9*01__IGHJ6*01 | 535 | 1140 | gnl\|Fabrus\|L25__IGKJ3*01 | 826 | 1431 |
| 1046 | gnl\|Fabrus\|VH1-8__IGHD2-15*01__IGHJ6*01 | 515 | 1120 | gnl\|Fabrus\|L25__IGKJ3*01 | 826 | 1431 |
| 1047 | gnl\|Fabrus\|VH2-70__IGHD2-15*01__IGHJ2*01 | 540 | 1145 | gnl\|Fabrus\|L25__IGKJ3*01 | 826 | 1431 |
| 1048 | gnl\|Fabrus\|VH3-38__IGHD3-10*01__IGHJ4*01 | 639 | 1244 | gnl\|Fabrus\|L25__IGKJ3*01 | 826 | 1431 |
| 1049 | gnl\|Fabrus\|VH3-16__IGHD1-7*01__IGHJ6*01 | 570 | 1175 | gnl\|Fabrus\|L25__IGKJ3*01 | 826 | 1431 |
| 1050 | gnl\|Fabrus\|VH3-73__IGHD3-9*01__IGHJ6*01 | 706 | 1311 | gnl\|Fabrus\|L25__IGKJ3*01 | 826 | 1431 |
| 1051 | gnl\|Fabrus\|VH3-11__IGHD3-9*01__IGHJ6*01 | 548 | 1153 | gnl\|Fabrus\|L25__IGKJ3*01 | 826 | 1431 |
| 1052 | gnl\|Fabrus\|VH3-11__IGHD6-6*01__IGHJ1*01 | 552 | 1157 | gnl\|Fabrus\|L25__IGKJ3*01 | 826 | 1431 |
| 1053 | gnl\|Fabrus\|VH3-20__IGHD5-12*01__IGHJ4*01 | 584 | 1189 | gnl\|Fabrus\|L25__IGKJ3*01 | 826 | 1431 |
| 1054 | gnl\|Fabrus\|VH3-16__IGHD2-15*01__IGHJ2*01 | 571 | 1176 | gnl\|Fabrus\|L25__IGKJ3*01 | 826 | 1431 |
| 1055 | gnl\|Fabrus\|VH3-7__IGHD6-6*01__IGHJ1*01 | 692 | 1297 | gnl\|Fabrus\|L25__IGKJ3*01 | 826 | 1431 |
| 1056 | gnl\|Fabrus\|VH3-16__IGHD6-13*01__IGHJ4*01 | 576 | 1181 | gnl\|Fabrus\|L25__IGKJ3*01 | 826 | 1431 |
| 1057 | gnl\|Fabrus\|VH3-23__IGHD1-1*01__IGHJ4*01 | 595 | 1200 | gnl\|Fabrus\|A27__IGKJ1*01 | 812 | 1417 |
| 1058 | gnl\|Fabrus\|VH3-23__IGHD2-15*01__IGHJ4*01 | 598 | 1203 | gnl\|Fabrus\|A27__IGKJ1*01 | 812 | 1417 |
| 1059 | gnl\|Fabrus\|VH3-23__IGHD3-22*01__IGHJ4*01 | 602 | 1207 | gnl\|Fabrus\|A27__IGKJ1*01 | 812 | 1417 |
| 1060 | gnl\|Fabrus\|VH3-23__IGHD4-11*01__IGHJ4*01 | 604 | 1209 | gnl\|Fabrus\|A27__IGKJ1*01 | 812 | 1417 |
| 1061 | gnl\|Fabrus\|VH3-23__IGHD5-12*01__IGHJ4*01 | 606 | 1211 | gnl\|Fabrus\|A27__IGKJ1*01 | 812 | 1417 |
| 1062 | gnl\|Fabrus\|VH3-23__IGHD5-5*01__IGHJ4*01 | 608 | 1213 | gnl\|Fabrus\|A27__IGKJ1*01 | 812 | 1417 |
| 1063 | gnl\|Fabrus\|VH3-23__IGHD6-13*01__IGHJ4*01 | 609 | 1214 | gnl\|Fabrus\|A27__IGKJ1*01 | 812 | 1417 |
| 1064 | gnl\|Fabrus\|VH3-23__IGHD7-27*01__IGHJ4*01 | 612 | 1217 | gnl\|Fabrus\|A27__IGKJ1*01 | 812 | 1417 |
| 1065 | gnl\|Fabrus\|VH3-23__IGHD7-27*01__IGHJ6*01 | 613 | 1218 | gnl\|Fabrus\|A27__IGKJ1*01 | 812 | 1417 |
| 1066 | gnl\|Fabrus\|VH1-69__IGHD1-14*01__IGHJ4*01 | 502 | 1107 | gnl\|Fabrus\|A27__IGKJ1*01 | 812 | 1417 |
| 1067 | gnl\|Fabrus\|VH1-69__IGHD2-2*01__IGHJ4*01 | 503 | 1108 | gnl\|Fabrus\|A27__IGKJ1*01 | 812 | 1417 |
| 1068 | gnl\|Fabrus\|VH1-69__IGHD2-8*01__IGHJ6*01 | 504 | 1109 | gnl\|Fabrus\|A27__IGKJ1*01 | 812 | 1417 |
| 1069 | gnl\|Fabrus\|VH1-69__IGHD3-16*01__IGHJ4*01 | 505 | 1110 | gnl\|Fabrus\|A27__IGKJ1*01 | 812 | 1417 |
| 1070 | gnl\|Fabrus\|VH1-69__IGHD3-3*01__IGHJ4*01 | 506 | 1111 | gnl\|Fabrus\|A27__IGKJ1*01 | 812 | 1417 |
| 1071 | gnl\|Fabrus\|VH1-69__IGHD4-17*01__IGHJ4*01 | 508 | 1113 | gnl\|Fabrus\|A27__IGKJ1*01 | 812 | 1417 |
| 1072 | gnl\|Fabrus\|VH1-69__IGHD5-12*01__IGHJ4*01 | 509 | 1114 | gnl\|Fabrus\|A27__IGKJ1*01 | 812 | 1417 |
| 1073 | gnl\|Fabrus\|VH1-69__IGHD6-19*01__IGHJ4*01 | 511 | 1116 | gnl\|Fabrus\|A27__IGKJ1*01 | 812 | 1417 |
| 1074 | gnl\|Fabrus\|VH1-69__IGHD7-27*01__IGHJ4*01 | 513 | 1118 | gnl\|Fabrus\|A27__IGKJ1*01 | 812 | 1417 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 1075 | gnl\|Fabrus\|VH4-34__IGHD1-7*01__IGHJ4*01 | 749 | 1354 | gnl\|Fabrus\|A27__IGKJ1*01 | 812 | 1417 |
| 1076 | gnl\|Fabrus\|VH4-34__IGHD2-2*01__IGHJ4*01 | 750 | 1355 | gnl\|Fabrus\|A27__IGKJ1*01 | 812 | 1417 |
| 1077 | gnl\|Fabrus\|VH4-34__IGHD3-16*01__IGHJ4*01 | 751 | 1356 | gnl\|Fabrus\|A27__IGKJ1*01 | 812 | 1417 |
| 1078 | gnl\|Fabrus\|VH4-34__IGHD4-17*01__IGHJ4*01 | 753 | 1358 | gnl\|Fabrus\|A27__IGKJ1*01 | 812 | 1417 |
| 1079 | gnl\|Fabrus\|VH4-34__IGHD5-12*01__IGHJ4*01 | 754 | 1359 | gnl\|Fabrus\|A27__IGKJ1*01 | 812 | 1417 |
| 1080 | gnl\|Fabrus\|VH4-34__IGHD6-13*01__IGHJ4*01 | 755 | 1360 | gnl\|Fabrus\|A27__IGKJ1*01 | 812 | 1417 |
| 1081 | gnl\|Fabrus\|VH4-34__IGHD6-25*01__IGHJ6*01 | 756 | 1361 | gnl\|Fabrus\|A27__IGKJ1*01 | 812 | 1417 |
| 1082 | gnl\|Fabrus\|VH4-34__IGHD7-27*01__IGHJ4*01 | 758 | 1363 | gnl\|Fabrus\|A27__IGKJ1*01 | 812 | 1417 |
| 1083 | gnl\|Fabrus\|VH2-26__IGHD1-20*01__IGHJ4*01 | 521 | 1126 | gnl\|Fabrus\|A27__IGKJ1*01 | 812 | 1417 |
| 1084 | gnl\|Fabrus\|VH2-26__IGHD2-2*01__IGHJ4*01 | 523 | 1128 | gnl\|Fabrus\|A27__IGKJ1*01 | 812 | 1417 |
| 1085 | gnl\|Fabrus\|VH2-26__IGHD3-10*01__IGHJ4*01 | 524 | 1129 | gnl\|Fabrus\|A27__IGKJ1*01 | 812 | 1417 |
| 1086 | gnl\|Fabrus\|VH2-26__IGHD4-11*01__IGHJ4*01 | 526 | 1131 | gnl\|Fabrus\|A27__IGKJ1*01 | 812 | 1417 |
| 1087 | gnl\|Fabrus\|VH2-26__IGHD5-18*01__IGHJ4*01 | 528 | 1133 | gnl\|Fabrus\|A27__IGKJ1*01 | 812 | 1417 |
| 1088 | gnl\|Fabrus\|VH2-26__IGHD6-13*01__IGHJ4*01 | 529 | 1134 | gnl\|Fabrus\|A27__IGKJ1*01 | 812 | 1417 |
| 1089 | gnl\|Fabrus\|VH2-26__IGHD7-27*01__IGHJ4*01 | 530 | 1135 | gnl\|Fabrus\|A27__IGKJ1*01 | 812 | 1417 |
| 1090 | gnl\|Fabrus\|VH5-51__IGHD1-14*01__IGHJ4*01 | 776 | 1381 | gnl\|Fabrus\|A27__IGKJ1*01 | 812 | 1417 |
| 1091 | gnl\|Fabrus\|VH5-51__IGHD2-8*01__IGHJ4*01 | 778 | 1383 | gnl\|Fabrus\|A27__IGKJ1*01 | 812 | 1417 |
| 1092 | gnl\|Fabrus\|VH5-51__IGHD3-3*01__IGHJ4*01 | 780 | 1385 | gnl\|Fabrus\|A27__IGKJ1*01 | 812 | 1417 |
| 1093 | gnl\|Fabrus\|VH5-51__IGHD4-17*01__IGHJ4*01 | 781 | 1386 | gnl\|Fabrus\|A27__IGKJ1*01 | 812 | 1417 |
| 1094 | gnl\|Fabrus\|VH5-51__IGHD5-18*01>3__IGHJ4*01 | 782 | 1387 | gnl\|Fabrus\|A27__IGKJ1*01 | 812 | 1417 |
| 1095 | gnl\|Fabrus\|VH5-51__IGHD5-18*01>1__IGHJ4*01 | 783 | 1388 | gnl\|Fabrus\|A27__IGKJ1*01 | 812 | 1417 |
| 1096 | gnl\|Fabrus\|VH5-51__IGHD6-25*01__IGHJ4*01 | 784 | 1389 | gnl\|Fabrus\|A27__IGKJ1*01 | 812 | 1417 |
| 1097 | gnl\|Fabrus\|VH5-51__IGHD7-27*01__IGHJ4*01 | 785 | 1390 | gnl\|Fabrus\|A27__IGKJ1*01 | 812 | 1417 |
| 1098 | gnl\|Fabrus\|VH6-1__IGHD1-1*01__IGHJ4*01 | 786 | 1391 | gnl\|Fabrus\|A27__IGKJ1*01 | 812 | 1417 |
| 1099 | gnl\|Fabrus\|VH6-1__IGHD2-15*01__IGHJ4*01 | 788 | 1393 | gnl\|Fabrus\|A27__IGKJ1*01 | 812 | 1417 |
| 1100 | gnl\|Fabrus\|VH6-1__IGHD3-3*01__IGHJ4*01 | 791 | 1396 | gnl\|Fabrus\|A27__IGKJ1*01 | 812 | 1417 |
| 1101 | gnl\|Fabrus\|VH6-1__IGHD4-23*01__IGHJ4*01 | 793 | 1398 | gnl\|Fabrus\|A27__IGKJ1*01 | 812 | 1417 |
| 1102 | gnl\|Fabrus\|VH6-1__IGHD4-11*01__IGHJ6*01 | 792 | 1397 | gnl\|Fabrus\|A27__IGKJ1*01 | 812 | 1417 |
| 1103 | gnl\|Fabrus\|VH6-1__IGHD5-5*01__IGHJ4*01 | 794 | 1399 | gnl\|Fabrus\|A27__IGKJ1*01 | 812 | 1417 |
| 1104 | gnl\|Fabrus\|VH6-1__IGHD6-13*01__IGHJ4*01 | 795 | 1400 | gnl\|Fabrus\|A27__IGKJ1*01 | 812 | 1417 |
| 1105 | gnl\|Fabrus\|VH6-1__IGHD6-25*01__IGHJ6*01 | 796 | 1401 | gnl\|Fabrus\|A27__IGKJ1*01 | 812 | 1417 |
| 1106 | gnl\|Fabrus\|VH6-1__IGHD7-27*01__IGHJ4*01 | 797 | 1402 | gnl\|Fabrus\|A27__IGKJ1*01 | 812 | 1417 |
| 1107 | gnl\|Fabrus\|VH4-59__IGHD6-25*01__IGHJ3*01 | 775 | 1380 | gnl\|Fabrus\|A27__IGKJ1*01 | 812 | 1417 |
| 1108 | gnl\|Fabrus\|VH3-48__IGHD6-6*01__IGHJ1*01 | 655 | 1260 | gnl\|Fabrus\|A27__IGKJ1*01 | 812 | 1417 |
| 1109 | gnl\|Fabrus\|VH3-30__IGHD6-6*01__IGHJ1*01 | 625 | 1230 | gnl\|Fabrus\|A27__IGKJ1*01 | 812 | 1417 |
| 1110 | gnl\|Fabrus\|VH3-66__IGHD6-6*01__IGHJ1*01 | 681 | 1286 | gnl\|Fabrus\|A27__IGKJ1*01 | 812 | 1417 |
| 1111 | gnl\|Fabrus\|VH3-53__IGHD5-5*01__IGHJ4*01 | 670 | 1275 | gnl\|Fabrus\|A27__IGKJ1*01 | 812 | 1417 |
| 1112 | gnl\|Fabrus\|VH2-5__IGHD5-12*01__IGHJ4*01 | 536 | 1141 | gnl\|Fabrus\|A27__IGKJ1*01 | 812 | 1417 |
| 1113 | gnl\|Fabrus\|VH2-70__IGHD5-12*01__IGHJ4*01 | 543 | 1148 | gnl\|Fabrus\|A27__IGKJ1*01 | 812 | 1417 |
| 1114 | gnl\|Fabrus\|VH3-15__IGHD5-12*01__IGHJ4*01 | 567 | 1172 | gnl\|Fabrus\|A27__IGKJ1*01 | 812 | 1417 |
| 1115 | gnl\|Fabrus\|VH3-15__IGHD3-10*01__IGHJ4*01 | 565 | 1170 | gnl\|Fabrus\|A27__IGKJ1*01 | 812 | 1417 |
| 1116 | gnl\|Fabrus\|VH3-49__IGHD5-18*01__IGHJ4*01 | 662 | 1267 | gnl\|Fabrus\|A27__IGKJ1*01 | 812 | 1417 |
| 1117 | gnl\|Fabrus\|VH3-49__IGHD6-13*01__IGHJ4*01 | 663 | 1268 | gnl\|Fabrus\|A27__IGKJ1*01 | 812 | 1417 |
| 1118 | gnl\|Fabrus\|VH3-72__IGHD5-18*01__IGHJ4*01 | 699 | 1304 | gnl\|Fabrus\|A27__IGKJ1*01 | 812 | 1417 |
| 1119 | gnl\|Fabrus\|VH3-72__IGHD6-6*01__IGHJ1*01 | 701 | 1306 | gnl\|Fabrus\|A27__IGKJ1*01 | 812 | 1417 |
| 1120 | gnl\|Fabrus\|VH3-73__IGHD5-12*01__IGHJ4*01 | 709 | 1314 | gnl\|Fabrus\|A27__IGKJ1*01 | 812 | 1417 |
| 1121 | gnl\|Fabrus\|VH3-73__IGHD4-23*01__IGHJ5*01 | 708 | 1313 | gnl\|Fabrus\|A27__IGKJ1*01 | 812 | 1417 |
| 1122 | gnl\|Fabrus\|VH3-43__IGHD3-22*01__IGHJ4*01 | 650 | 1255 | gnl\|Fabrus\|A27__IGKJ1*01 | 812 | 1417 |
| 1123 | gnl\|Fabrus\|VH3-43__IGHD6-13*01__IGHJ4*01 | 653 | 1258 | gnl\|Fabrus\|A27__IGKJ1*01 | 812 | 1417 |
| 1124 | gnl\|Fabrus\|VH3-9__IGHD3-22*01__IGHJ4*01 | 724 | 1329 | gnl\|Fabrus\|A27__IGKJ1*01 | 812 | 1417 |
| 1125 | gnl\|Fabrus\|VH3-9__IGHD1-7*01__IGHJ5*01 | 721 | 1326 | gnl\|Fabrus\|A27__IGKJ1*01 | 812 | 1417 |
| 1126 | gnl\|Fabrus\|VH3-9__IGHD6-13*01__IGHJ4*01 | 727 | 1332 | gnl\|Fabrus\|A27__IGKJ1*01 | 812 | 1417 |
| 1127 | gnl\|Fabrus\|VH4-39__IGHD3-10*01__IGHJ4*01 | 762 | 1367 | gnl\|Fabrus\|A27__IGKJ1*01 | 812 | 1417 |
| 1128 | gnl\|Fabrus\|VH4-39__IGHD5-12*01__IGHJ4*01 | 766 | 1371 | gnl\|Fabrus\|A27__IGKJ1*01 | 812 | 1417 |
| 1129 | gnl\|Fabrus\|VH1-18__IGHD6-6*01__IGHJ1*01 | 460 | 1065 | gnl\|Fabrus\|A27__IGKJ1*01 | 812 | 1417 |
| 1130 | gnl\|Fabrus\|VH1-24__IGHD5-12*01__IGHJ4*01 | 467 | 1072 | gnl\|Fabrus\|A27__IGKJ1*01 | 812 | 1417 |
| 1131 | gnl\|Fabrus\|VH1-2__IGHD1-1*01__IGHJ3*01 | 461 | 1066 | gnl\|Fabrus\|A27__IGKJ1*01 | 812 | 1417 |
| 1132 | gnl\|Fabrus\|VH1-3__IGHD6-6*01__IGHJ1*01 | 475 | 1080 | gnl\|Fabrus\|A27__IGKJ1*01 | 812 | 1417 |
| 1133 | gnl\|Fabrus\|VH1-45__IGHD3-10*01__IGHJ4*01 | 480 | 1085 | gnl\|Fabrus\|A27__IGKJ1*01 | 812 | 1417 |
| 1134 | gnl\|Fabrus\|VH1-46__IGHD1-26*01__IGHJ4*01 | 486 | 1091 | gnl\|Fabrus\|A27__IGKJ1*01 | 812 | 1417 |
| 1135 | gnl\|Fabrus\|VH7-81__IGHD2-21*01__IGHJ6*01 | 800 | 1405 | gnl\|Fabrus\|A27__IGKJ1*01 | 812 | 1417 |
| 1136 | gnl\|Fabrus\|VH2-70__IGHD3-9*01__IGHJ6*01 | 542 | 1147 | gnl\|Fabrus\|A27__IGKJ1*01 | 812 | 1417 |
| 1137 | gnl\|Fabrus\|VH1-58__IGHD3-10*01__IGHJ6*01 | 496 | 1101 | gnl\|Fabrus\|A27__IGKJ1*01 | 812 | 1417 |
| 1138 | gnl\|Fabrus\|VH7-81__IGHD2-21*01__IGHJ2*01 | 799 | 1404 | gnl\|Fabrus\|A27__IGKJ1*01 | 812 | 1417 |
| 1139 | gnl\|Fabrus\|VH4-28__IGHD3-9*01__IGHJ6*01 | 734 | 1339 | gnl\|Fabrus\|A27__IGKJ1*01 | 812 | 1417 |
| 1140 | gnl\|Fabrus\|VH4-31__IGHD2-15*01__IGHJ2*01 | 740 | 1345 | gnl\|Fabrus\|A27__IGKJ1*01 | 812 | 1417 |
| 1141 | gnl\|Fabrus\|VH2-5__IGHD3-9*01__IGHJ6*01 | 535 | 1140 | gnl\|Fabrus\|A27__IGKJ1*01 | 812 | 1417 |
| 1142 | gnl\|Fabrus\|VH1-8__IGHD2-15*01__IGHJ6*01 | 515 | 1120 | gnl\|Fabrus\|A27__IGKJ1*01 | 812 | 1417 |
| 1143 | gnl\|Fabrus\|VH2-70__IGHD2-15*01__IGHJ2*01 | 540 | 1145 | gnl\|Fabrus\|A27__IGKJ1*01 | 812 | 1417 |
| 1144 | gnl\|Fabrus\|VH3-38__IGHD3-10*01__IGHJ6*01 | 639 | 1244 | gnl\|Fabrus\|A27__IGKJ1*01 | 812 | 1417 |
| 1145 | gnl\|Fabrus\|VH3-16__IGHD1-7*01__IGHJ6*01 | 570 | 1175 | gnl\|Fabrus\|A27__IGKJ1*01 | 812 | 1417 |
| 1146 | gnl\|Fabrus\|VH3-73__IGHD3-9*01__IGHJ6*01 | 706 | 1311 | gnl\|Fabrus\|A27__IGKJ1*01 | 812 | 1417 |
| 1147 | gnl\|Fabrus\|VH3-11__IGHD3-9*01__IGHJ6*01 | 548 | 1153 | gnl\|Fabrus\|A27__IGKJ1*01 | 812 | 1417 |
| 1148 | gnl\|Fabrus\|VH3-11__IGHD6-6*01__IGHJ1*01 | 552 | 1157 | gnl\|Fabrus\|A27__IGKJ1*01 | 812 | 1417 |
| 1149 | gnl\|Fabrus\|VH3-20__IGHD5-12*01__IGHJ4*01 | 584 | 1189 | gnl\|Fabrus\|A27__IGKJ1*01 | 812 | 1417 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 1150 | gnl\|Fabrus\|VH3-16__IGHD2-15*01__IGHJ2*01 | 571 | 1176 | gnl\|Fabrus\|A27__IGKJ1*01 | 812 | 1417 |
| 1151 | gnl\|Fabrus\|VH3-7__IGHD6-6*01__IGHJ1*01 | 692 | 1297 | gnl\|Fabrus\|A27__IGKJ1*01 | 812 | 1417 |
| 1152 | gnl\|Fabrus\|VH3-16__IGHD6-13*01__IGHJ4*01 | 576 | 1181 | gnl\|Fabrus\|A27__IGKJ1*01 | 812 | 1417 |
| 1153 | gnl\|Fabrus\|VH3-23__IGHD1-1*01__IGHJ4*01 | 595 | 1200 | gnl\|Fabrus\|A2__IGKJ1*01 | 808 | 1413 |
| 1154 | gnl\|Fabrus\|VH3-23__IGHD2-15*01__IGHJ4*01 | 598 | 1203 | gnl\|Fabrus\|A2__IGKJ1*01 | 808 | 1413 |
| 1155 | gnl\|Fabrus\|VH3-23__IGHD3-22*01__IGHJ4*01 | 602 | 1207 | gnl\|Fabrus\|A2__IGKJ1*01 | 808 | 1413 |
| 1156 | gnl\|Fabrus\|VH3-23__IGHD4-11*01__IGHJ4*01 | 604 | 1209 | gnl\|Fabrus\|A2__IGKJ1*01 | 808 | 1413 |
| 1157 | gnl\|Fabrus\|VH3-23__IGHD5-12*01__IGHJ4*01 | 606 | 1211 | gnl\|Fabrus\|A2__IGKJ1*01 | 808 | 1413 |
| 1158 | gnl\|Fabrus\|VH3-23__IGHD5-5*01__IGHJ4*01 | 608 | 1213 | gnl\|Fabrus\|A2__IGKJ1*01 | 808 | 1413 |
| 1159 | gnl\|Fabrus\|VH3-23__IGHD6-13*01__IGHJ4*01 | 609 | 1214 | gnl\|Fabrus\|A2__IGKJ1*01 | 808 | 1413 |
| 1160 | gnl\|Fabrus\|VH3-23__IGHD7-27*01__IGHJ4*01 | 612 | 1217 | gnl\|Fabrus\|A2__IGKJ1*01 | 808 | 1413 |
| 1161 | gnl\|Fabrus\|VH3-23__IGHD7-27*01__IGHJ6*01 | 613 | 1218 | gnl\|Fabrus\|A2__IGKJ1*01 | 808 | 1413 |
| 1162 | gnl\|Fabrus\|VH1-69__IGHD1-14*01__IGHJ4*01 | 502 | 1107 | gnl\|Fabrus\|A2__IGKJ1*01 | 808 | 1413 |
| 1163 | gnl\|Fabrus\|VH1-69__IGHD2-2*01__IGHJ4*01 | 503 | 1108 | gnl\|Fabrus\|A2__IGKJ1*01 | 808 | 1413 |
| 1164 | gnl\|Fabrus\|VH1-69__IGHD2-8*01__IGHJ6*01 | 504 | 1109 | gnl\|Fabrus\|A2__IGKJ1*01 | 808 | 1413 |
| 1165 | gnl\|Fabrus\|VH1-69__IGHD3-16*01__IGHJ4*01 | 505 | 1110 | gnl\|Fabrus\|A2__IGKJ1*01 | 808 | 1413 |
| 1166 | gnl\|Fabrus\|VH1-69__IGHD3-3*01__IGHJ4*01 | 506 | 1111 | gnl\|Fabrus\|A2__IGKJ1*01 | 808 | 1413 |
| 1167 | gnl\|Fabrus\|VH1-69__IGHD4-17*01__IGHJ4*01 | 508 | 1113 | gnl\|Fabrus\|A2__IGKJ1*01 | 808 | 1413 |
| 1168 | gnl\|Fabrus\|VH1-69__IGHD5-12*01__IGHJ4*01 | 509 | 1114 | gnl\|Fabrus\|A2__IGKJ1*01 | 808 | 1413 |
| 1169 | gnl\|Fabrus\|VH1-69__IGHD6-19*01__IGHJ4*01 | 511 | 1116 | gnl\|Fabrus\|A2__IGKJ1*01 | 808 | 1413 |
| 1170 | gnl\|Fabrus\|VH1-69__IGHD7-27*01__IGHJ4*01 | 513 | 1118 | gnl\|Fabrus\|A2__IGKJ1*01 | 808 | 1413 |
| 1171 | gnl\|Fabrus\|VH4-34__IGHD1-7*01__IGHJ4*01 | 749 | 1354 | gnl\|Fabrus\|A2__IGKJ1*01 | 808 | 1413 |
| 1172 | gnl\|Fabrus\|VH4-34__IGHD2-2*01__IGHJ4*01 | 750 | 1355 | gnl\|Fabrus\|A2__IGKJ1*01 | 808 | 1413 |
| 1173 | gnl\|Fabrus\|VH4-34__IGHD3-16*01__IGHJ4*01 | 751 | 1356 | gnl\|Fabrus\|A2__IGKJ1*01 | 808 | 1413 |
| 1174 | gnl\|Fabrus\|VH4-34__IGHD4-17*01__IGHJ4*01 | 753 | 1358 | gnl\|Fabrus\|A2__IGKJ1*01 | 808 | 1413 |
| 1175 | gnl\|Fabrus\|VH4-34__IGHD5-12*01__IGHJ4*01 | 754 | 1359 | gnl\|Fabrus\|A2__IGKJ1*01 | 808 | 1413 |
| 1176 | gnl\|Fabrus\|VH4-34__IGHD6-13*01__IGHJ4*01 | 755 | 1360 | gnl\|Fabrus\|A2__IGKJ1*01 | 808 | 1413 |
| 1177 | gnl\|Fabrus\|VH4-34__IGHD6-25*01__IGHJ6*01 | 756 | 1361 | gnl\|Fabrus\|A2__IGKJ1*01 | 808 | 1413 |
| 1178 | gnl\|Fabrus\|VH4-34__IGHD7-27*01__IGHJ4*01 | 758 | 1363 | gnl\|Fabrus\|A2__IGKJ1*01 | 808 | 1413 |
| 1179 | gnl\|Fabrus\|VH2-26__IGHD1-20*01__IGHJ4*01 | 521 | 1126 | gnl\|Fabrus\|A2__IGKJ1*01 | 808 | 1413 |
| 1180 | gnl\|Fabrus\|VH2-26__IGHD2-2*01__IGHJ4*01 | 523 | 1128 | gnl\|Fabrus\|A2__IGKJ1*01 | 808 | 1413 |
| 1181 | gnl\|Fabrus\|VH2-26__IGHD3-10*01__IGHJ4*01 | 524 | 1129 | gnl\|Fabrus\|A2__IGKJ1*01 | 808 | 1413 |
| 1182 | gnl\|Fabrus\|VH2-26__IGHD4-11*01__IGHJ4*01 | 526 | 1131 | gnl\|Fabrus\|A2__IGKJ1*01 | 808 | 1413 |
| 1183 | gnl\|Fabrus\|VH2-26__IGHD5-18*01__IGHJ4*01 | 528 | 1133 | gnl\|Fabrus\|A2__IGKJ1*01 | 808 | 1413 |
| 1184 | gnl\|Fabrus\|VH2-26__IGHD6-13*01__IGHJ4*01 | 529 | 1134 | gnl\|Fabrus\|A2__IGKJ1*01 | 808 | 1413 |
| 1185 | gnl\|Fabrus\|VH2-26__IGHD7-27*01__IGHJ4*01 | 530 | 1135 | gnl\|Fabrus\|A2__IGKJ1*01 | 808 | 1413 |
| 1186 | gnl\|Fabrus\|VH5-51__IGHD1-14*01__IGHJ4*01 | 776 | 1381 | gnl\|Fabrus\|A2__IGKJ1*01 | 808 | 1413 |
| 1187 | gnl\|Fabrus\|VH5-51__IGHD2-8*01__IGHJ4*01 | 778 | 1383 | gnl\|Fabrus\|A2__IGKJ1*01 | 808 | 1413 |
| 1188 | gnl\|Fabrus\|VH5-51__IGHD3-3*01__IGHJ4*01 | 780 | 1385 | gnl\|Fabrus\|A2__IGKJ1*01 | 808 | 1413 |
| 1189 | gnl\|Fabrus\|VH5-51__IGHD4-17*01__IGHJ4*01 | 781 | 1386 | gnl\|Fabrus\|A2__IGKJ1*01 | 808 | 1413 |
| 1190 | gnl\|Fabrus\|VH5-51__IGHD5-18*01>3__IGHJ4*01 | 782 | 1387 | gnl\|Fabrus\|A2__IGKJ1*01 | 808 | 1413 |
| 1191 | gnl\|Fabrus\|VH5-51__IGHD5-18*01>1__IGHJ4*01 | 783 | 1388 | gnl\|Fabrus\|A2__IGKJ1*01 | 808 | 1413 |
| 1192 | gnl\|Fabrus\|VH5-51__IGHD6-25*01__IGHJ4*01 | 784 | 1389 | gnl\|Fabrus\|A2__IGKJ1*01 | 808 | 1413 |
| 1193 | gnl\|Fabrus\|VH5-51__IGHD7-27*01__IGHJ4*01 | 785 | 1390 | gnl\|Fabrus\|A2__IGKJ1*01 | 808 | 1413 |
| 1194 | gnl\|Fabrus\|VH6-1__IGHD1-1*01__IGHJ4*01 | 786 | 1391 | gnl\|Fabrus\|A2__IGKJ1*01 | 808 | 1413 |
| 1195 | gnl\|Fabrus\|VH6-1__IGHD2-15*01__IGHJ4*01 | 788 | 1393 | gnl\|Fabrus\|A2__IGKJ1*01 | 808 | 1413 |
| 1196 | gnl\|Fabrus\|VH6-1__IGHD3-3*01__IGHJ4*01 | 791 | 1396 | gnl\|Fabrus\|A2__IGKJ1*01 | 808 | 1413 |
| 1197 | gnl\|Fabrus\|VH6-1__IGHD4-23*01__IGHJ4*01 | 793 | 1398 | gnl\|Fabrus\|A2__IGKJ1*01 | 808 | 1413 |
| 1198 | gnl\|Fabrus\|VH6-1__IGHD4-11*01__IGHJ6*01 | 792 | 1397 | gnl\|Fabrus\|A2__IGKJ1*01 | 808 | 1413 |
| 1199 | gnl\|Fabrus\|VH6-1__IGHD5-5*01__IGHJ4*01 | 794 | 1399 | gnl\|Fabrus\|A2__IGKJ1*01 | 808 | 1413 |
| 1200 | gnl\|Fabrus\|VH6-1__IGHD6-13*01__IGHJ4*01 | 795 | 1400 | gnl\|Fabrus\|A2__IGKJ1*01 | 808 | 1413 |
| 1201 | gnl\|Fabrus\|VH6-1__IGHD6-25*01__IGHJ6*01 | 796 | 1401 | gnl\|Fabrus\|A2__IGKJ1*01 | 808 | 1413 |
| 1202 | gnl\|Fabrus\|VH6-1__IGHD7-27*01__IGHJ4*01 | 797 | 1402 | gnl\|Fabrus\|A2__IGKJ1*01 | 808 | 1413 |
| 1203 | gnl\|Fabrus\|VH4-59__IGHD6-25*01__IGHJ3*01 | 775 | 1380 | gnl\|Fabrus\|A2__IGKJ1*01 | 808 | 1413 |
| 1204 | gnl\|Fabrus\|VH3-48__IGHD6-6*01__IGHJ1*01 | 655 | 1260 | gnl\|Fabrus\|A2__IGKJ1*01 | 808 | 1413 |
| 1205 | gnl\|Fabrus\|VH3-30__IGHD6-6*01__IGHJ1*01 | 625 | 1230 | gnl\|Fabrus\|A2__IGKJ1*01 | 808 | 1413 |
| 1206 | gnl\|Fabrus\|VH3-66__IGHD6-6*01__IGHJ1*01 | 681 | 1286 | gnl\|Fabrus\|A2__IGKJ1*01 | 808 | 1413 |
| 1207 | gnl\|Fabrus\|VH3-53__IGHD5-5*01__IGHJ4*01 | 670 | 1275 | gnl\|Fabrus\|A2__IGKJ1*01 | 808 | 1413 |
| 1208 | gnl\|Fabrus\|VH2-5__IGHD5-12*01__IGHJ4*01 | 536 | 1141 | gnl\|Fabrus\|A2__IGKJ1*01 | 808 | 1413 |
| 1209 | gnl\|Fabrus\|VH2-70__IGHD5-12*01__IGHJ4*01 | 543 | 1148 | gnl\|Fabrus\|A2__IGKJ1*01 | 808 | 1413 |
| 1210 | gnl\|Fabrus\|VH3-15__IGHD5-12*01__IGHJ4*01 | 567 | 1172 | gnl\|Fabrus\|A2__IGKJ1*01 | 808 | 1413 |
| 1211 | gnl\|Fabrus\|VH3-15__IGHD3-10*01__IGHJ4*01 | 565 | 1170 | gnl\|Fabrus\|A2__IGKJ1*01 | 808 | 1413 |
| 1212 | gnl\|Fabrus\|VH3-49__IGHD5-18*01__IGHJ4*01 | 662 | 1267 | gnl\|Fabrus\|A2__IGKJ1*01 | 808 | 1413 |
| 1213 | gnl\|Fabrus\|VH3-49__IGHD6-13*01__IGHJ4*01 | 663 | 1268 | gnl\|Fabrus\|A2__IGKJ1*01 | 808 | 1413 |
| 1214 | gnl\|Fabrus\|VH3-72__IGHD5-18*01__IGHJ4*01 | 699 | 1304 | gnl\|Fabrus\|A2__IGKJ1*01 | 808 | 1413 |
| 1215 | gnl\|Fabrus\|VH3-72__IGHD6-6*01__IGHJ1*01 | 701 | 1306 | gnl\|Fabrus\|A2__IGKJ1*01 | 808 | 1413 |
| 1216 | gnl\|Fabrus\|VH3-73__IGHD5-12*01__IGHJ4*01 | 709 | 1314 | gnl\|Fabrus\|A2__IGKJ1*01 | 808 | 1413 |
| 1217 | gnl\|Fabrus\|VH3-73__IGHD4-23*01__IGHJ5*01 | 708 | 1313 | gnl\|Fabrus\|A2__IGKJ1*01 | 808 | 1413 |
| 1218 | gnl\|Fabrus\|VH3-43__IGHD3-22*01__IGHJ4*01 | 650 | 1255 | gnl\|Fabrus\|A2__IGKJ1*01 | 808 | 1413 |
| 1219 | gnl\|Fabrus\|VH3-43__IGHD6-13*01__IGHJ4*01 | 653 | 1258 | gnl\|Fabrus\|A2__IGKJ1*01 | 808 | 1413 |
| 1220 | gnl\|Fabrus\|VH3-9__IGHD3-22*01__IGHJ4*01 | 724 | 1329 | gnl\|Fabrus\|A2__IGKJ1*01 | 808 | 1413 |
| 1221 | gnl\|Fabrus\|VH3-9__IGHD1-7*01__IGHJ5*01 | 721 | 1326 | gnl\|Fabrus\|A2__IGKJ1*01 | 808 | 1413 |
| 1222 | gnl\|Fabrus\|VH3-9__IGHD6-13*01__IGHJ4*01 | 727 | 1332 | gnl\|Fabrus\|A2__IGKJ1*01 | 808 | 1413 |
| 1223 | gnl\|Fabrus\|VH4-39__IGHD3-10*01__IGHJ4*01 | 762 | 1367 | gnl\|Fabrus\|A2__IGKJ1*01 | 808 | 1413 |
| 1224 | gnl\|Fabrus\|VH4-39__IGHD5-12*01__IGHJ4*01 | 766 | 1371 | gnl\|Fabrus\|A2__IGKJ1*01 | 808 | 1413 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 1225 | gnl\|Fabrus\|VH1-18__IGHD6-6*01__IGHJ1*01 | 460 | 1065 | gnl\|Fabrus\|A2__IGKJ1*01 | 808 | 1413 |
| 1226 | gnl\|Fabrus\|VH1-24__IGHD5-12*01__IGHJ4*01 | 467 | 1072 | gnl\|Fabrus\|A2__IGKJ1*01 | 808 | 1413 |
| 1227 | gnl\|Fabrus\|VH1-2__IGHD1-1*01__IGHJ3*01 | 461 | 1066 | gnl\|Fabrus\|A2__IGKJ1*01 | 808 | 1413 |
| 1228 | gnl\|Fabrus\|VH1-3__IGHD6-6*01__IGHJ1*01 | 475 | 1080 | gnl\|Fabrus\|A2__IGKJ1*01 | 808 | 1413 |
| 1229 | gnl\|Fabrus\|VH1-45__IGHD3-10*01__IGHJ4*01 | 480 | 1085 | gnl\|Fabrus\|A2__IGKJ1*01 | 808 | 1413 |
| 1230 | gnl\|Fabrus\|VH1-46__IGHD1-26*01__IGHJ4*01 | 486 | 1091 | gnl\|Fabrus\|A2__IGKJ1*01 | 808 | 1413 |
| 1231 | gnl\|Fabrus\|VH7-81__IGHD2-21*01__IGHJ6*01 | 800 | 1405 | gnl\|Fabrus\|A2__IGKJ1*01 | 808 | 1413 |
| 1232 | gnl\|Fabrus\|VH2-70__IGHD3-9*01__IGHJ6*01 | 542 | 1147 | gnl\|Fabrus\|A2__IGKJ1*01 | 808 | 1413 |
| 1233 | gnl\|Fabrus\|VH1-58__IGHD3-10*01__IGHJ6*01 | 496 | 1101 | gnl\|Fabrus\|A2__IGKJ1*01 | 808 | 1413 |
| 1234 | gnl\|Fabrus\|VH7-81__IGHD2-21*01__IGHJ2*01 | 799 | 1404 | gnl\|Fabrus\|A2__IGKJ1*01 | 808 | 1413 |
| 1235 | gnl\|Fabrus\|VH4-28__IGHD3-9*01__IGHJ6*01 | 734 | 1339 | gnl\|Fabrus\|A2__IGKJ1*01 | 808 | 1413 |
| 1236 | gnl\|Fabrus\|VH4-31__IGHD2-15*01__IGHJ2*01 | 740 | 1345 | gnl\|Fabrus\|A2__IGKJ1*01 | 808 | 1413 |
| 1237 | gnl\|Fabrus\|VH2-5__IGHD3-9*01__IGHJ6*01 | 535 | 1140 | gnl\|Fabrus\|A2__IGKJ1*01 | 808 | 1413 |
| 1238 | gnl\|Fabrus\|VH1-8__IGHD2-15*01__IGHJ6*01 | 515 | 1120 | gnl\|Fabrus\|A2__IGKJ1*01 | 808 | 1413 |
| 1239 | gnl\|Fabrus\|VH2-70__IGHD2-15*01__IGHJ2*01 | 540 | 1145 | gnl\|Fabrus\|A2__IGKJ1*01 | 808 | 1413 |
| 1240 | gnl\|Fabrus\|VH3-38__IGHD3-10*01__IGHJ4*01 | 639 | 1244 | gnl\|Fabrus\|A2__IGKJ1*01 | 808 | 1413 |
| 1241 | gnl\|Fabrus\|VH3-16__IGHD1-7*01__IGHJ6*01 | 570 | 1175 | gnl\|Fabrus\|A2__IGKJ1*01 | 808 | 1413 |
| 1242 | gnl\|Fabrus\|VH3-73__IGHD3-9*01__IGHJ6*01 | 706 | 1311 | gnl\|Fabrus\|A2__IGKJ1*01 | 808 | 1413 |
| 1243 | gnl\|Fabrus\|VH3-11__IGHD3-9*01__IGHJ6*01 | 548 | 1153 | gnl\|Fabrus\|A2__IGKJ1*01 | 808 | 1413 |
| 1244 | gnl\|Fabrus\|VH3-11__IGHD6-6*01__IGHJ1*01 | 552 | 1157 | gnl\|Fabrus\|A2__IGKJ1*01 | 808 | 1413 |
| 1245 | gnl\|Fabrus\|VH3-20__IGHD5-12*01__IGHJ4*01 | 584 | 1189 | gnl\|Fabrus\|A2__IGKJ1*01 | 808 | 1413 |
| 1246 | gnl\|Fabrus\|VH3-16__IGHD2-15*01__IGHJ2*01 | 571 | 1176 | gnl\|Fabrus\|A2__IGKJ1*01 | 808 | 1413 |
| 1247 | gnl\|Fabrus\|VH3-7__IGHD6-6*01__IGHJ1*01 | 692 | 1297 | gnl\|Fabrus\|A2__IGKJ1*01 | 808 | 1413 |
| 1248 | gnl\|Fabrus\|VH3-16__IGHD6-13*01__IGHJ4*01 | 576 | 1181 | gnl\|Fabrus\|A2__IGKJ1*01 | 808 | 1413 |
| 1249 | gnl\|Fabrus\|VH3-23__IGHD1-1*01__IGHJ4*01 | 595 | 1200 | gnl\|Fabrus\|HerceptinLC | 818 | 1423 |
| 1250 | gnl\|Fabrus\|VH3-23__IGHD2-15*01__IGHJ4*01 | 598 | 1203 | gnl\|Fabrus\|HerceptinLC | 818 | 1423 |
| 1251 | gnl\|Fabrus\|VH3-23__IGHD3-22*01__IGHJ4*01 | 602 | 1207 | gnl\|Fabrus\|HerceptinLC | 818 | 1423 |
| 1252 | gnl\|Fabrus\|VH3-23__IGHD4-11*01__IGHJ4*01 | 604 | 1209 | gnl\|Fabrus\|HerceptinLC | 818 | 1423 |
| 1253 | gnl\|Fabrus\|VH3-23__IGHD5-12*01__IGHJ4*01 | 606 | 1211 | gnl\|Fabrus\|HerceptinLC | 818 | 1423 |
| 1254 | gnl\|Fabrus\|VH3-23__IGHD5-5*01__IGHJ4*01 | 608 | 1213 | gnl\|Fabrus\|HerceptinLC | 818 | 1423 |
| 1255 | gnl\|Fabrus\|VH3-23__IGHD6-13*01__IGHJ4*01 | 609 | 1214 | gnl\|Fabrus\|HerceptinLC | 818 | 1423 |
| 1256 | gnl\|Fabrus\|VH3-23__IGHD7-27*01__IGHJ4*01 | 612 | 1217 | gnl\|Fabrus\|HerceptinLC | 818 | 1423 |
| 1257 | gnl\|Fabrus\|VH3-23__IGHD7-27*01__IGHJ6*01 | 613 | 1218 | gnl\|Fabrus\|HerceptinLC | 818 | 1423 |
| 1258 | gnl\|Fabrus\|VH1-69__IGHD1-14*01__IGHJ4*01 | 502 | 1107 | gnl\|Fabrus\|HerceptinLC | 818 | 1423 |
| 1259 | gnl\|Fabrus\|VH1-69__IGHD2-2*01__IGHJ4*01 | 503 | 1108 | gnl\|Fabrus\|HerceptinLC | 818 | 1423 |
| 1260 | gnl\|Fabrus\|VH1-69__IGHD2-8*01__IGHJ6*01 | 504 | 1109 | gnl\|Fabrus\|HerceptinLC | 818 | 1423 |
| 1261 | gnl\|Fabrus\|VH1-69__IGHD3-16*01__IGHJ4*01 | 505 | 1110 | gnl\|Fabrus\|HerceptinLC | 818 | 1423 |
| 1262 | gnl\|Fabrus\|VH1-69__IGHD3-3*01__IGHJ4*01 | 506 | 1111 | gnl\|Fabrus\|HerceptinLC | 818 | 1423 |
| 1263 | gnl\|Fabrus\|VH1-69__IGHD4-17*01__IGHJ4*01 | 508 | 1113 | gnl\|Fabrus\|HerceptinLC | 818 | 1423 |
| 1264 | gnl\|Fabrus\|VH1-69__IGHD5-12*01__IGHJ4*01 | 509 | 1114 | gnl\|Fabrus\|HerceptinLC | 818 | 1423 |
| 1265 | gnl\|Fabrus\|VH1-69__IGHD6-19*01__IGHJ4*01 | 511 | 1116 | gnl\|Fabrus\|HerceptinLC | 818 | 1423 |
| 1266 | gnl\|Fabrus\|VH1-69__IGHD7-27*01__IGHJ4*01 | 513 | 1118 | gnl\|Fabrus\|HerceptinLC | 818 | 1423 |
| 1267 | gnl\|Fabrus\|VH4-34__IGHD1-7*01__IGHJ4*01 | 749 | 1354 | gnl\|Fabrus\|HerceptinLC | 818 | 1423 |
| 1268 | gnl\|Fabrus\|VH4-34__IGHD2-2*01__IGHJ4*01 | 750 | 1355 | gnl\|Fabrus\|HerceptinLC | 818 | 1423 |
| 1269 | gnl\|Fabrus\|VH4-34__IGHD3-16*01__IGHJ4*01 | 751 | 1356 | gnl\|Fabrus\|HerceptinLC | 818 | 1423 |
| 1270 | gnl\|Fabrus\|VH4-34__IGHD4-17*01__IGHJ4*01 | 753 | 1358 | gnl\|Fabrus\|HerceptinLC | 818 | 1423 |
| 1271 | gnl\|Fabrus\|VH4-34__IGHD5-12*01__IGHJ4*01 | 754 | 1359 | gnl\|Fabrus\|HerceptinLC | 818 | 1423 |
| 1272 | gnl\|Fabrus\|VH4-34__IGHD6-13*01__IGHJ4*01 | 755 | 1360 | gnl\|Fabrus\|HerceptinLC | 818 | 1423 |
| 1273 | gnl\|Fabrus\|VH4-34__IGHD6-25*01__IGHJ6*01 | 756 | 1361 | gnl\|Fabrus\|HerceptinLC | 818 | 1423 |
| 1274 | gnl\|Fabrus\|VH4-34__IGHD7-27*01__IGHJ4*01 | 758 | 1363 | gnl\|Fabrus\|HerceptinLC | 818 | 1423 |
| 1275 | gnl\|Fabrus\|VH2-26__IGHD1-20*01__IGHJ4*01 | 521 | 1126 | gnl\|Fabrus\|HerceptinLC | 818 | 1423 |
| 1276 | gnl\|Fabrus\|VH2-26__IGHD2-2*01__IGHJ4*01 | 523 | 1128 | gnl\|Fabrus\|HerceptinLC | 818 | 1423 |
| 1277 | gnl\|Fabrus\|VH2-26__IGHD3-10*01__IGHJ4*01 | 524 | 1129 | gnl\|Fabrus\|HerceptinLC | 818 | 1423 |
| 1278 | gnl\|Fabrus\|VH2-26__IGHD4-11*01__IGHJ4*01 | 526 | 1131 | gnl\|Fabrus\|HerceptinLC | 818 | 1423 |
| 1279 | gnl\|Fabrus\|VH2-26__IGHD5-18*01__IGHJ4*01 | 528 | 1133 | gnl\|Fabrus\|HerceptinLC | 818 | 1423 |
| 1280 | gnl\|Fabrus\|VH2-26__IGHD6-13*01__IGHJ4*01 | 529 | 1134 | gnl\|Fabrus\|HerceptinLC | 818 | 1423 |
| 1281 | gnl\|Fabrus\|VH2-26__IGHD7-27*01__IGHJ4*01 | 530 | 1135 | gnl\|Fabrus\|HerceptinLC | 818 | 1423 |
| 1282 | gnl\|Fabrus\|VH5-51__IGHD1-14*01__IGHJ4*01 | 776 | 1381 | gnl\|Fabrus\|HerceptinLC | 818 | 1423 |
| 1283 | gnl\|Fabrus\|VH5-51__IGHD2-8*01__IGHJ4*01 | 778 | 1383 | gnl\|Fabrus\|HerceptinLC | 818 | 1423 |
| 1284 | gnl\|Fabrus\|VH5-51__IGHD3-3*01__IGHJ4*01 | 780 | 1385 | gnl\|Fabrus\|HerceptinLC | 818 | 1423 |
| 1285 | gnl\|Fabrus\|VH5-51__IGHD4-17*01__IGHJ4*01 | 781 | 1386 | gnl\|Fabrus\|HerceptinLC | 818 | 1423 |
| 1286 | gnl\|Fabrus\|VH5-51__IGHD5-18*01>3__IGHJ4*01 | 782 | 1387 | gnl\|Fabrus\|HerceptinLC | 818 | 1423 |
| 1287 | gnl\|Fabrus\|VH5-51__IGHD5-18*01>1__IGHJ4*01 | 783 | 1388 | gnl\|Fabrus\|HerceptinLC | 818 | 1423 |
| 1288 | gnl\|Fabrus\|VH5-51__IGHD6-25*01__IGHJ4*01 | 784 | 1389 | gnl\|Fabrus\|HerceptinLC | 818 | 1423 |
| 1289 | gnl\|Fabrus\|VH5-51__IGHD7-27*01__IGHJ4*01 | 785 | 1390 | gnl\|Fabrus\|HerceptinLC | 818 | 1423 |
| 1290 | gnl\|Fabrus\|VH6-1__IGHD1-1*01__IGHJ4*01 | 786 | 1391 | gnl\|Fabrus\|HerceptinLC | 818 | 1423 |
| 1291 | gnl\|Fabrus\|VH6-1__IGHD2-15*01__IGHJ4*01 | 788 | 1393 | gnl\|Fabrus\|HerceptinLC | 818 | 1423 |
| 1292 | gnl\|Fabrus\|VH6-1__IGHD3-3*01__IGHJ4*01 | 791 | 1396 | gnl\|Fabrus\|HerceptinLC | 818 | 1423 |
| 1293 | gnl\|Fabrus\|VH6-1__IGHD4-23*01__IGHJ4*01 | 793 | 1398 | gnl\|Fabrus\|HerceptinLC | 818 | 1423 |
| 1294 | gnl\|Fabrus\|VH6-1__IGHD4-11*01__IGHJ6*01 | 792 | 1397 | gnl\|Fabrus\|HerceptinLC | 818 | 1423 |
| 1295 | gnl\|Fabrus\|VH6-1__IGHD5-5*01__IGHJ4*01 | 794 | 1399 | gnl\|Fabrus\|HerceptinLC | 818 | 1423 |
| 1296 | gnl\|Fabrus\|VH6-1__IGHD6-13*01__IGHJ4*01 | 795 | 1400 | gnl\|Fabrus\|HerceptinLC | 818 | 1423 |
| 1297 | gnl\|Fabrus\|VH6-1__IGHD6-25*01__IGHJ6*01 | 796 | 1401 | gnl\|Fabrus\|HerceptinLC | 818 | 1423 |
| 1298 | gnl\|Fabrus\|VH6-1__IGHD7-27*01__IGHJ4*01 | 797 | 1402 | gnl\|Fabrus\|HerceptinLC | 818 | 1423 |
| 1299 | gnl\|Fabrus\|VH4-59__IGHD6-25*01__IGHJ3*01 | 775 | 1380 | gnl\|Fabrus\|HerceptinLC | 818 | 1423 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 1300 | gnl\|Fabrus\|VH3-48__IGHD6-6*01__IGHJ1*01 | 655 | 1260 | gnl\|Fabrus\|HerceptinLC | 818 | 1423 |
| 1301 | gnl\|Fabrus\|VH3-30__IGHD6-6*01__IGHJ1*01 | 625 | 1230 | gnl\|Fabrus\|HerceptinLC | 818 | 1423 |
| 1302 | gnl\|Fabrus\|VH3-66__IGHD6-6*01__IGHJ1*01 | 681 | 1286 | gnl\|Fabrus\|HerceptinLC | 818 | 1423 |
| 1303 | gnl\|Fabrus\|VH3-53__IGHD5-5*01__IGHJ4*01 | 670 | 1275 | gnl\|Fabrus\|HerceptinLC | 818 | 1423 |
| 1304 | gnl\|Fabrus\|VH2-5__IGHD5-12*01__IGHJ4*01 | 536 | 1141 | gnl\|Fabrus\|HerceptinLC | 818 | 1423 |
| 1305 | gnl\|Fabrus\|VH2-70__IGHD5-12*01__IGHJ4*01 | 543 | 1148 | gnl\|Fabrus\|HerceptinLC | 818 | 1423 |
| 1306 | gnl\|Fabrus\|VH3-15__IGHD5-12*01__IGHJ4*01 | 567 | 1172 | gnl\|Fabrus\|HerceptinLC | 818 | 1423 |
| 1307 | gnl\|Fabrus\|VH3-15__IGHD3-10*01__IGHJ4*01 | 565 | 1170 | gnl\|Fabrus\|HerceptinLC | 818 | 1423 |
| 1308 | gnl\|Fabrus\|VH3-49__IGHD5-18*01__IGHJ4*01 | 662 | 1267 | gnl\|Fabrus\|HerceptinLC | 818 | 1423 |
| 1309 | gnl\|Fabrus\|VH3-49__IGHD6-13*01__IGHJ4*01 | 663 | 1268 | gnl\|Fabrus\|HerceptinLC | 818 | 1423 |
| 1310 | gnl\|Fabrus\|VH3-72__IGHD5-18*01__IGHJ4*01 | 699 | 1304 | gnl\|Fabrus\|HerceptinLC | 818 | 1423 |
| 1311 | gnl\|Fabrus\|VH3-72__IGHD6-6*01__IGHJ1*01 | 701 | 1306 | gnl\|Fabrus\|HerceptinLC | 818 | 1423 |
| 1312 | gnl\|Fabrus\|VH3-73__IGHD5-12*01__IGHJ4*01 | 709 | 1314 | gnl\|Fabrus\|HerceptinLC | 818 | 1423 |
| 1313 | gnl\|Fabrus\|VH3-73__IGHD4-23*01__IGHJ5*01 | 708 | 1313 | gnl\|Fabrus\|HerceptinLC | 818 | 1423 |
| 1314 | gnl\|Fabrus\|VH3-43__IGHD3-22*01__IGHJ4*01 | 650 | 1255 | gnl\|Fabrus\|HerceptinLC | 818 | 1423 |
| 1315 | gnl\|Fabrus\|VH3-43__IGHD6-13*01__IGHJ4*01 | 653 | 1258 | gnl\|Fabrus\|HerceptinLC | 818 | 1423 |
| 1316 | gnl\|Fabrus\|VH3-9__IGHD3-22*01__IGHJ4*01 | 724 | 1329 | gnl\|Fabrus\|HerceptinLC | 818 | 1423 |
| 1317 | gnl\|Fabrus\|VH3-9__IGHD1-7*01__IGHJ5*01 | 721 | 1326 | gnl\|Fabrus\|HerceptinLC | 818 | 1423 |
| 1318 | gnl\|Fabrus\|VH3-9__IGHD6-13*01__IGHJ4*01 | 727 | 1332 | gnl\|Fabrus\|HerceptinLC | 818 | 1423 |
| 1319 | gnl\|Fabrus\|VH4-39__IGHD3-10*01__IGHJ4*01 | 762 | 1367 | gnl\|Fabrus\|HerceptinLC | 818 | 1423 |
| 1320 | gnl\|Fabrus\|VH4-39__IGHD5-12*01__IGHJ4*01 | 766 | 1371 | gnl\|Fabrus\|HerceptinLC | 818 | 1423 |
| 1321 | gnl\|Fabrus\|VH1-18__IGHD6-6*01__IGHJ1*01 | 460 | 1065 | gnl\|Fabrus\|HerceptinLC | 818 | 1423 |
| 1322 | gnl\|Fabrus\|VH1-24__IGHD5-12*01__IGHJ4*01 | 467 | 1072 | gnl\|Fabrus\|HerceptinLC | 818 | 1423 |
| 1323 | gnl\|Fabrus\|VH1-2__IGHD1-1*01__IGHJ3*01 | 461 | 1066 | gnl\|Fabrus\|HerceptinLC | 818 | 1423 |
| 1324 | gnl\|Fabrus\|VH1-3__IGHD6-6*01__IGHJ1*01 | 475 | 1080 | gnl\|Fabrus\|HerceptinLC | 818 | 1423 |
| 1325 | gnl\|Fabrus\|VH1-45__IGHD3-10*01__IGHJ4*01 | 480 | 1085 | gnl\|Fabrus\|HerceptinLC | 818 | 1423 |
| 1326 | gnl\|Fabrus\|VH1-46__IGHD1-26*01__IGHJ4*01 | 486 | 1091 | gnl\|Fabrus\|HerceptinLC | 818 | 1423 |
| 1327 | gnl\|Fabrus\|VH7-81__IGHD2-21*01__IGHJ6*01 | 800 | 1405 | gnl\|Fabrus\|HerceptinLC | 818 | 1423 |
| 1328 | gnl\|Fabrus\|VH2-70__IGHD3-9*01__IGHJ6*01 | 542 | 1147 | gnl\|Fabrus\|HerceptinLC | 818 | 1423 |
| 1329 | gnl\|Fabrus\|VH1-58__IGHD3-10*01__IGHJ6*01 | 496 | 1101 | gnl\|Fabrus\|HerceptinLC | 818 | 1423 |
| 1330 | gnl\|Fabrus\|VH7-81__IGHD2-21*01__IGHJ2*01 | 799 | 1404 | gnl\|Fabrus\|HerceptinLC | 818 | 1423 |
| 1331 | gnl\|Fabrus\|VH4-28__IGHD3-9*01__IGHJ6*01 | 734 | 1339 | gnl\|Fabrus\|HerceptinLC | 818 | 1423 |
| 1332 | gnl\|Fabrus\|VH4-31__IGHD2-15*01__IGHJ2*01 | 740 | 1345 | gnl\|Fabrus\|HerceptinLC | 818 | 1423 |
| 1333 | gnl\|Fabrus\|VH2-5__IGHD3-9*01__IGHJ6*01 | 535 | 1140 | gnl\|Fabrus\|HerceptinLC | 818 | 1423 |
| 1334 | gnl\|Fabrus\|VH1-8__IGHD2-15*01__IGHJ6*01 | 515 | 1120 | gnl\|Fabrus\|HerceptinLC | 818 | 1423 |
| 1335 | gnl\|Fabrus\|VH2-70__IGHD2-15*01__IGHJ2*01 | 540 | 1145 | gnl\|Fabrus\|HerceptinLC | 818 | 1423 |
| 1336 | gnl\|Fabrus\|VH3-38__IGHD3-10*01__IGHJ4*01 | 639 | 1244 | gnl\|Fabrus\|HerceptinLC | 818 | 1423 |
| 1337 | gnl\|Fabrus\|VH3-16__IGHD1-7*01__IGHJ6*01 | 570 | 1175 | gnl\|Fabrus\|HerceptinLC | 818 | 1423 |
| 1338 | gnl\|Fabrus\|VH3-73__IGHD3-9*01__IGHJ6*01 | 706 | 1311 | gnl\|Fabrus\|HerceptinLC | 818 | 1423 |
| 1339 | gnl\|Fabrus\|VH3-11__IGHD3-9*01__IGHJ6*01 | 548 | 1153 | gnl\|Fabrus\|HerceptinLC | 818 | 1423 |
| 1340 | gnl\|Fabrus\|VH3-11__IGHD6-6*01__IGHJ1*01 | 552 | 1157 | gnl\|Fabrus\|HerceptinLC | 818 | 1423 |
| 1341 | gnl\|Fabrus\|VH3-20__IGHD5-12*01__IGHJ4*01 | 584 | 1189 | gnl\|Fabrus\|HerceptinLC | 818 | 1423 |
| 1342 | gnl\|Fabrus\|VH3-16__IGHD2-15*01__IGHJ2*01 | 571 | 1176 | gnl\|Fabrus\|HerceptinLC | 818 | 1423 |
| 1343 | gnl\|Fabrus\|VH3-7__IGHD6-6*01__IGHJ1*01 | 692 | 1297 | gnl\|Fabrus\|HerceptinLC | 818 | 1423 |
| 1344 | gnl\|Fabrus\|VH3-16__IGHD6-13*01__IGHJ4*01 | 576 | 1181 | gnl\|Fabrus\|HerceptinLC | 818 | 1423 |
| 1345 | gnl\|Fabrus\|VH3-23__IGHD3-10*01__IGHJ4*01 | 600 | 1205 | gnl\|Fabrus\|O12__IGKJ1*01 | 833 | 1438 |
| 1346 | gnl\|Fabrus\|VH3-23__IGHD3-10*01__IGHJ4*01 | 600 | 1205 | gnl\|Fabrus\|O18__IGKJ1*01 | 834 | 1439 |
| 1347 | gnl\|Fabrus\|VH3-23__IGHD3-10*01__IGHJ4*01 | 600 | 1205 | gnl\|Fabrus\|A20__IGKJ1*01 | 809 | 1414 |
| 1348 | gnl\|Fabrus\|VH3-23__IGHD3-10*01__IGHJ4*01 | 600 | 1205 | gnl\|Fabrus\|A30__IGKJ1*01 | 814 | 1419 |
| 1349 | gnl\|Fabrus\|VH3-23__IGHD3-10*01__IGHJ4*01 | 600 | 1205 | gnl\|Fabrus\|L14__IGKJ1*01 | 821 | 1426 |
| 1350 | gnl\|Fabrus\|VH3-23__IGHD3-10*01__IGHJ4*01 | 600 | 1205 | gnl\|Fabrus\|L4/18a__IGKJ1*01 | 827 | 1432 |
| 1351 | gnl\|Fabrus\|VH3-23__IGHD3-10*01__IGHJ4*01 | 600 | 1205 | gnl\|Fabrus\|L5__IGKJ1*01 | 828 | 1433 |
| 1352 | gnl\|Fabrus\|VH3-23__IGHD3-10*01__IGHJ4*01 | 600 | 1205 | gnl\|Fabrus\|L8__IGKJ1*01 | 830 | 1435 |
| 1353 | gnl\|Fabrus\|VH3-23__IGHD3-10*01__IGHJ4*01 | 600 | 1205 | gnl\|Fabrus\|L23__IGKJ1*01 | 824 | 1429 |
| 1354 | gnl\|Fabrus\|VH3-23__IGHD3-10*01__IGHJ4*01 | 600 | 1205 | gnl\|Fabrus\|L11__IGKJ1*01 | 819 | 1424 |
| 1355 | gnl\|Fabrus\|VH3-23__IGHD3-10*01__IGHJ4*01 | 600 | 1205 | gnl\|Fabrus\|L12__IGKJ1*01 | 820 | 1425 |
| 1356 | gnl\|Fabrus\|VH3-23__IGHD3-10*01__IGHJ4*01 | 600 | 1205 | gnl\|Fabrus\|O1__IGKJ1*01 | 832 | 1437 |
| 1357 | gnl\|Fabrus\|VH3-23__IGHD3-10*01__IGHJ4*01 | 600 | 1205 | gnl\|Fabrus\|A17__IGKJ1*01 | 807 | 1412 |
| 1358 | gnl\|Fabrus\|VH3-23__IGHD3-10*01__IGHJ4*01 | 600 | 1205 | gnl\|Fabrus\|A2__IGKJ1*01 | 808 | 1413 |
| 1359 | gnl\|Fabrus\|VH3-23__IGHD3-10*01__IGHJ4*01 | 600 | 1205 | gnl\|Fabrus\|A23__IGKJ1*01 | 810 | 1415 |
| 1360 | gnl\|Fabrus\|VH3-23__IGHD3-10*01__IGHJ4*01 | 600 | 1205 | gnl\|Fabrus\|A27__IGKJ3*01 | 813 | 1418 |
| 1361 | gnl\|Fabrus\|VH3-23__IGHD3-10*01__IGHJ4*01 | 600 | 1205 | gnl\|Fabrus\|L2__IGKJ1*01 | 822 | 1427 |
| 1362 | gnl\|Fabrus\|VH3-23__IGHD3-10*01__IGHJ4*01 | 600 | 1205 | gnl\|Fabrus\|L6__IGKJ1*01 | 829 | 1434 |
| 1363 | gnl\|Fabrus\|VH3-23__IGHD3-10*01__IGHJ4*01 | 600 | 1205 | gnl\|Fabrus\|L25__IGKJ1*01 | 825 | 1430 |
| 1364 | gnl\|Fabrus\|VH3-23__IGHD3-10*01__IGHJ4*01 | 600 | 1205 | gnl\|Fabrus\|B3__IGKJ1*01 | 817 | 1422 |
| 1365 | gnl\|Fabrus\|VH3-23__IGHD3-10*01__IGHJ4*01 | 600 | 1205 | gnl\|Fabrus\|B2__IGKJ1*01 | 815 | 1420 |
| 1366 | gnl\|Fabrus\|VH3-23__IGHD3-10*01__IGHJ4*01 | 600 | 1205 | gnl\|Fabrus\|A26__IGKJ1*01 | 811 | 1416 |
| 1367 | gnl\|Fabrus\|VH3-23__IGHD3-10*01__IGHJ4*01 | 600 | 1205 | gnl\|Fabrus\|A14__IGKJ1*01 | 806 | 1411 |
| 1368 | gnl\|Fabrus\|VH3-23__IGHD3-10*01__IGHJ4*01 | 600 | 1205 | gnl\|Fabrus\|L9__IGKJ2*01 | 831 | 1436 |
| 1369 | gnl\|Fabrus\|VH3-23__IGHD3-10*01__IGHJ4*01 | 600 | 1205 | gnl\|Fabrus\|A27__IGKJ1*01 | 812 | 1417 |
| 1370 | gnl\|Fabrus\|VH3-23__IGHD3-10*01__IGHJ4*01 | 600 | 1205 | gnl\|Fabrus\|B2__IGKJ3*01 | 816 | 1421 |
| 1371 | gnl\|Fabrus\|VH3-23__IGHD3-10*01__IGHJ4*01 | 600 | 1205 | gnl\|Fabrus\|L25__IGKJ3*01 | 826 | 1431 |
| 1372 | gnl\|Fabrus\|VH3-23__IGHD3-10*01__IGHJ4*01 | 600 | 1205 | gnl\|Fabrus\|RituxanLC | 835 | 1440 |
| 1373 | gnl\|Fabrus\|VH3-23__IGHD3-10*01__IGHJ4*01 | 600 | 1205 | gnl\|Fabrus\|L22__IGKJ3*01 | 823 | 1428 |
| 1374 | gnl\|Fabrus\|VH3-23__IGHD3-10*01__IGHJ4*01 | 600 | 1205 | gnl\|Fabrus\|HerceptinLC | 818 | 1423 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 1375 | gnl|Fabrus|VH4-31__IGHD6-6*01__IGHJ1*01 | 747 | 1352 | gnl|Fabrus|O12__IGKJ1*01 | 833 | 1438 |
| 1376 | gnl|Fabrus|VH4-31__IGHD6-6*01__IGHJ1*01 | 747 | 1352 | gnl|Fabrus|O18__IGKJ1*01 | 834 | 1439 |
| 1377 | gnl|Fabrus|VH4-31__IGHD6-6*01__IGHJ1*01 | 747 | 1352 | gnl|Fabrus|A20__IGKJ1*01 | 809 | 1414 |
| 1378 | gnl|Fabrus|VH4-31__IGHD6-6*01__IGHJ1*01 | 747 | 1352 | gnl|Fabrus|A30__IGKJ1*01 | 814 | 1419 |
| 1379 | gnl|Fabrus|VH4-31__IGHD6-6*01__IGHJ1*01 | 747 | 1352 | gnl|Fabrus|L14__IGKJ1*01 | 821 | 1426 |
| 1380 | gnl|Fabrus|VH4-31__IGHD6-6*01__IGHJ1*01 | 747 | 1352 | gnl|Fabrus|L4/18a__IGKJ1*01 | 827 | 1432 |
| 1381 | gnl|Fabrus|VH4-31__IGHD6-6*01__IGHJ1*01 | 747 | 1352 | gnl|Fabrus|L5__IGKJ1*01 | 828 | 1433 |
| 1382 | gnl|Fabrus|VH4-31__IGHD6-6*01__IGHJ1*01 | 747 | 1352 | gnl|Fabrus|L8__IGKJ1*01 | 830 | 1435 |
| 1383 | gnl|Fabrus|VH4-31__IGHD6-6*01__IGHJ1*01 | 747 | 1352 | gnl|Fabrus|L23__IGKJ1*01 | 824 | 1429 |
| 1384 | gnl|Fabrus|VH4-31__IGHD6-6*01__IGHJ1*01 | 747 | 1352 | gnl|Fabrus|L11__IGKJ1*01 | 819 | 1424 |
| 1385 | gnl|Fabrus|VH4-31__IGHD6-6*01__IGHJ1*01 | 747 | 1352 | gnl|Fabrus|L12__IGKJ1*01 | 820 | 1425 |
| 1386 | gnl|Fabrus|VH4-31__IGHD6-6*01__IGHJ1*01 | 747 | 1352 | gnl|Fabrus|O1__IGKJ1*01 | 832 | 1437 |
| 1387 | gnl|Fabrus|VH4-31__IGHD6-6*01__IGHJ1*01 | 747 | 1352 | gnl|Fabrus|A17__IGKJ1*01 | 807 | 1412 |
| 1388 | gnl|Fabrus|VH4-31__IGHD6-6*01__IGHJ1*01 | 747 | 1352 | gnl|Fabrus|A2__IGKJ1*01 | 808 | 1413 |
| 1389 | gnl|Fabrus|VH4-31__IGHD6-6*01__IGHJ1*01 | 747 | 1352 | gnl|Fabrus|A23__IGKJ1*01 | 810 | 1415 |
| 1390 | gnl|Fabrus|VH4-31__IGHD6-6*01__IGHJ1*01 | 747 | 1352 | gnl|Fabrus|A27__IGKJ3*01 | 813 | 1418 |
| 1391 | gnl|Fabrus|VH4-31__IGHD6-6*01__IGHJ1*01 | 747 | 1352 | gnl|Fabrus|L2__IGKJ1*01 | 822 | 1427 |
| 1392 | gnl|Fabrus|VH4-31__IGHD6-6*01__IGHJ1*01 | 747 | 1352 | gnl|Fabrus|L6__IGKJ1*01 | 829 | 1434 |
| 1393 | gnl|Fabrus|VH4-31__IGHD6-6*01__IGHJ1*01 | 747 | 1352 | gnl|Fabrus|L25__IGKJ1*01 | 825 | 1430 |
| 1394 | gnl|Fabrus|VH4-31__IGHD6-6*01__IGHJ1*01 | 747 | 1352 | gnl|Fabrus|B3__IGKJ1*01 | 817 | 1422 |
| 1395 | gnl|Fabrus|VH4-31__IGHD6-6*01__IGHJ1*01 | 747 | 1352 | gnl|Fabrus|B2__IGKJ1*01 | 815 | 1420 |
| 1396 | gnl|Fabrus|VH4-31__IGHD6-6*01__IGHJ1*01 | 747 | 1352 | gnl|Fabrus|A26__IGKJ1*01 | 811 | 1416 |
| 1397 | gnl|Fabrus|VH4-31__IGHD6-6*01__IGHJ1*01 | 747 | 1352 | gnl|Fabrus|A14__IGKJ1*01 | 806 | 1411 |
| 1398 | gnl|Fabrus|VH4-31__IGHD6-6*01__IGHJ1*01 | 747 | 1352 | gnl|Fabrus|L9__IGKJ2*01 | 831 | 1436 |
| 1399 | gnl|Fabrus|VH4-31__IGHD6-6*01__IGHJ1*01 | 747 | 1352 | gnl|Fabrus|A27__IGKJ1*01 | 812 | 1417 |
| 1400 | gnl|Fabrus|VH4-31__IGHD6-6*01__IGHJ1*01 | 747 | 1352 | gnl|Fabrus|B2__IGKJ3*01 | 816 | 1421 |
| 1401 | gnl|Fabrus|VH4-31__IGHD6-6*01__IGHJ1*01 | 747 | 1352 | gnl|Fabrus|L25__IGKJ3*01 | 826 | 1431 |
| 1402 | gnl|Fabrus|VH4-31__IGHD6-6*01__IGHJ1*01 | 747 | 1352 | gnl|Fabrus|RituxanLC | 835 | 1440 |
| 1403 | gnl|Fabrus|VH4-31__IGHD6-6*01__IGHJ1*01 | 747 | 1352 | gnl|Fabrus|L22__IGKJ3*01 | 823 | 1428 |
| 1404 | gnl|Fabrus|VH4-31__IGHD6-6*01__IGHJ1*01 | 747 | 1352 | gnl|Fabrus|HerceptinLC | 818 | 1423 |
| 1405 | gnl|Fabrus|RituxanHC | 453 | 1058 | gnl|Fabrus|O12__IGKJ1*01 | 833 | 1438 |
| 1406 | gnl|Fabrus|RituxanHC | 453 | 1058 | gnl|Fabrus|O18__IGKJ1*01 | 834 | 1439 |
| 1407 | gnl|Fabrus|RituxanHC | 453 | 1058 | gnl|Fabrus|A20__IGKJ1*01 | 809 | 1414 |
| 1408 | gnl|Fabrus|RituxanHC | 453 | 1058 | gnl|Fabrus|A30__IGKJ1*01 | 814 | 1419 |
| 1409 | gnl|Fabrus|RituxanHC | 453 | 1058 | gnl|Fabrus|L14__IGKJ1*01 | 821 | 1426 |
| 1410 | gnl|Fabrus|RituxanHC | 453 | 1058 | gnl|Fabrus|L4/18a__IGKJ1*01 | 827 | 1432 |
| 1411 | gnl|Fabrus|RituxanHC | 453 | 1058 | gnl|Fabrus|L5__IGKJ1*01 | 828 | 1433 |
| 1412 | gnl|Fabrus|RituxanHC | 453 | 1058 | gnl|Fabrus|L8__IGKJ1*01 | 830 | 1435 |
| 1413 | gnl|Fabrus|RituxanHC | 453 | 1058 | gnl|Fabrus|L23__IGKJ1*01 | 824 | 1429 |
| 1414 | gnl|Fabrus|RituxanHC | 453 | 1058 | gnl|Fabrus|L11__IGKJ1*01 | 819 | 1424 |
| 1415 | gnl|Fabrus|RituxanHC | 453 | 1058 | gnl|Fabrus|L12__IGKJ1*01 | 820 | 1425 |
| 1416 | gnl|Fabrus|RituxanHC | 453 | 1058 | gnl|Fabrus|O1__IGKJ1*01 | 832 | 1437 |
| 1417 | gnl|Fabrus|RituxanHC | 453 | 1058 | gnl|Fabrus|A17__IGKJ1*01 | 807 | 1412 |
| 1418 | gnl|Fabrus|RituxanHC | 453 | 1058 | gnl|Fabrus|A2__IGKJ1*01 | 808 | 1413 |
| 1419 | gnl|Fabrus|RituxanHC | 453 | 1058 | gnl|Fabrus|A23__IGKJ1*01 | 810 | 1415 |
| 1420 | gnl|Fabrus|RituxanHC | 453 | 1058 | gnl|Fabrus|A27__IGKJ3*01 | 813 | 1418 |
| 1421 | gnl|Fabrus|RituxanHC | 453 | 1058 | gnl|Fabrus|L2__IGKJ1*01 | 822 | 1427 |
| 1422 | gnl|Fabrus|RituxanHC | 453 | 1058 | gnl|Fabrus|L6__IGKJ1*01 | 829 | 1434 |
| 1423 | gnl|Fabrus|RituxanHC | 453 | 1058 | gnl|Fabrus|L25__IGKJ1*01 | 825 | 1430 |
| 1424 | gnl|Fabrus|RituxanHC | 453 | 1058 | gnl|Fabrus|B3__IGKJ1*01 | 817 | 1422 |
| 1425 | gnl|Fabrus|RituxanHC | 453 | 1058 | gnl|Fabrus|B2__IGKJ1*01 | 815 | 1420 |
| 1426 | gnl|Fabrus|RituxanHC | 453 | 1058 | gnl|Fabrus|A26__IGKJ1*01 | 811 | 1416 |
| 1427 | gnl|Fabrus|RituxanHC | 453 | 1058 | gnl|Fabrus|A14__IGKJ1*01 | 806 | 1411 |
| 1428 | gnl|Fabrus|RituxanHC | 453 | 1058 | gnl|Fabrus|L9__IGKJ2*01 | 831 | 1436 |
| 1429 | gnl|Fabrus|RituxanHC | 453 | 1058 | gnl|Fabrus|A27__IGKJ1*01 | 812 | 1417 |
| 1430 | gnl|Fabrus|RituxanHC | 453 | 1058 | gnl|Fabrus|B2__IGKJ3*01 | 816 | 1421 |
| 1431 | gnl|Fabrus|RituxanHC | 453 | 1058 | gnl|Fabrus|L25__IGKJ3*01 | 826 | 1431 |
| 1432 | gnl|Fabrus|RituxanHC | 453 | 1058 | gnl|Fabrus|RituxanLC | 835 | 1440 |
| 1433 | gnl|Fabrus|RituxanHC | 453 | 1058 | gnl|Fabrus|L22__IGKJ3*01 | 823 | 1428 |
| 1434 | gnl|Fabrus|RituxanHC | 453 | 1058 | gnl|Fabrus|HerceptinLC | 818 | 1423 |
| 1435 | gnl|Fabrus|HerceptinHC | 452 | 1057 | gnl|Fabrus|O12__IGKJ1*01 | 833 | 1438 |
| 1436 | gnl|Fabrus|HerceptinHC | 452 | 1057 | gnl|Fabrus|O18__IGKJ1*01 | 834 | 1439 |
| 1437 | gnl|Fabrus|HerceptinHC | 452 | 1057 | gnl|Fabrus|A20__IGKJ1*01 | 809 | 1414 |
| 1438 | gnl|Fabrus|HerceptinHC | 452 | 1057 | gnl|Fabrus|A30__IGKJ1*01 | 814 | 1419 |
| 1439 | gnl|Fabrus|HerceptinHC | 452 | 1057 | gnl|Fabrus|L14__IGKJ1*01 | 821 | 1426 |
| 1440 | gnl|Fabrus|HerceptinHC | 452 | 1057 | gnl|Fabrus|L4/18a__IGKJ1*01 | 827 | 1432 |
| 1441 | gnl|Fabrus|HerceptinHC | 452 | 1057 | gnl|Fabrus|L5__IGKJ1*01 | 828 | 1433 |
| 1442 | gnl|Fabrus|HerceptinHC | 452 | 1057 | gnl|Fabrus|L8__IGKJ1*01 | 830 | 1435 |
| 1443 | gnl|Fabrus|HerceptinHC | 452 | 1057 | gnl|Fabrus|L23__IGKJ1*01 | 824 | 1429 |
| 1444 | gnl|Fabrus|HerceptinHC | 452 | 1057 | gnl|Fabrus|L11__IGKJ1*01 | 819 | 1424 |
| 1445 | gnl|Fabrus|HerceptinHC | 452 | 1057 | gnl|Fabrus|L12__IGKJ1*01 | 820 | 1425 |
| 1446 | gnl|Fabrus|HerceptinHC | 452 | 1057 | gnl|Fabrus|O1__IGKJ1*01 | 832 | 1437 |
| 1447 | gnl|Fabrus|HerceptinHC | 452 | 1057 | gnl|Fabrus|A17__IGKJ1*01 | 807 | 1412 |
| 1448 | gnl|Fabrus|HerceptinHC | 452 | 1057 | gnl|Fabrus|A2__IGKJ1*01 | 808 | 1413 |
| 1449 | gnl|Fabrus|HerceptinHC | 452 | 1057 | gnl|Fabrus|A23__IGKJ1*01 | 810 | 1415 |

TABLE 17-continued

Exemplary Nucleic Acid Paired Library

| | Heavy Chain Name | RS SEQ ID NO | NO RS SEQ ID NO | Light Chain Name | RS SEQ ID NO | NO RS SEQ ID NO |
|---|---|---|---|---|---|---|
| 1450 | gnl\|Fabrus\|HerceptinHC | 452 | 1057 | gnl\|Fabrus\|A27__IGKJ3*01 | 813 | 1418 |
| 1451 | gnl\|Fabrus\|HerceptinHC | 452 | 1057 | gnl\|Fabrus\|L2__IGKJ1*01 | 822 | 1427 |
| 1452 | gnl\|Fabrus\|HerceptinHC | 452 | 1057 | gnl\|Fabrus\|L6__IGKJ1*01 | 829 | 1434 |
| 1453 | gnl\|Fabrus\|HerceptinHC | 452 | 1057 | gnl\|Fabrus\|L25__IGKJ1*01 | 825 | 1430 |
| 1454 | gnl\|Fabrus\|HerceptinHC | 452 | 1057 | gnl\|Fabrus\|B3__IGKJ1*01 | 817 | 1422 |
| 1455 | gnl\|Fabrus\|HerceptinHC | 452 | 1057 | gnl\|Fabrus\|B2__IGKJ1*01 | 815 | 1420 |
| 1456 | gnl\|Fabrus\|HerceptinHC | 452 | 1057 | gnl\|Fabrus\|A26__IGKJ1*01 | 811 | 1416 |
| 1457 | gnl\|Fabrus\|HerceptinHC | 452 | 1057 | gnl\|Fabrus\|A14__IGKJ1*01 | 806 | 1411 |
| 1458 | gnl\|Fabrus\|HerceptinHC | 452 | 1057 | gnl\|Fabrus\|L9__IGKJ2*01 | 831 | 1436 |
| 1459 | gnl\|Fabrus\|HerceptinHC | 452 | 1057 | gnl\|Fabrus\|A27__IGKJ1*01 | 812 | 1417 |
| 1460 | gnl\|Fabrus\|HerceptinHC | 452 | 1057 | gnl\|Fabrus\|B2__IGKJ3*01 | 816 | 1421 |
| 1461 | gnl\|Fabrus\|HerceptinHC | 452 | 1057 | gnl\|Fabrus\|L25__IGKJ3*01 | 826 | 1431 |
| 1462 | gnl\|Fabrus\|HerceptinHC | 452 | 1057 | gnl\|Fabrus\|RituxanLC | 835 | 1440 |
| 1463 | gnl\|Fabrus\|HerceptinHC | 452 | 1057 | gnl\|Fabrus\|L22__IGKJ3*01 | 823 | 1428 |
| 1464 | gnl\|Fabrus\|HerceptinHC | 452 | 1057 | gnl\|Fabrus\|HerceptinLC | 818 | 1423 |

An additional exemplary paired library is set forth in Table 17A, where each row sets forth a different loci of the library.

TABLE 17A

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 1 | VH3-23__IGHD1-1*01>1__IGHJ1*01 | 2070 | O12__IGKJ1*01 | 833 | 1438 |
| 2 | VH3-23__IGHD1-1*01>2__IGHJ1*01 | 2071 | O12__IGKJ1*01 | 833 | 1438 |
| 3 | VH3-23__IGHD1-1*01>3__IGHJ1*01 | 2072 | O12__IGKJ1*01 | 833 | 1438 |
| 4 | VH3-23__IGHD1-7*01>1__IGHJ1*01 | 2073 | O12__IGKJ1*01 | 833 | 1438 |
| 5 | VH3-23__IGHD1-7*01>3__IGHJ1*01 | 2074 | O12__IGKJ1*01 | 833 | 1438 |
| 6 | VH3-23__IGHD1-14*01>1__IGHJ1*01 | 2075 | O12__IGKJ1*01 | 833 | 1438 |
| 7 | VH3-23__IGHD1-14*01>3__IGHJ1*01 | 2076 | O12__IGKJ1*01 | 833 | 1438 |
| 8 | VH3-23__IGHD1-20*01>1__IGHJ1*01 | 2077 | O12__IGKJ1*01 | 833 | 1438 |
| 9 | VH3-23__IGHD1-20*01>3__IGHJ1*01 | 2078 | O12__IGKJ1*01 | 833 | 1438 |
| 10 | VH3-23__IGHD1-26*01>1__IGHJ1*01 | 2079 | O12__IGKJ1*01 | 833 | 1438 |
| 11 | VH3-23__IGHD1-26*01>3__IGHJ1*01 | 2080 | O12__IGKJ1*01 | 833 | 1438 |
| 12 | VH3-23__IGHD2-2*01>2__IGHJ1*01 | 2081 | O12__IGKJ1*01 | 833 | 1438 |
| 13 | VH3-23__IGHD2-2*01>3__IGHJ1*01 | 2082 | O12__IGKJ1*01 | 833 | 1438 |
| 14 | VH3-23__IGHD2-8*01>2__IGHJ1*01 | 2083 | O12__IGKJ1*01 | 833 | 1438 |
| 15 | VH3-23__IGHD2-8*01>3__IGHJ1*01 | 2084 | O12__IGKJ1*01 | 833 | 1438 |
| 16 | VH3-23__IGHD2-15*01>2__IGHJ1*01 | 2085 | O12__IGKJ1*01 | 833 | 1438 |
| 17 | VH3-23__IGHD2-15*01>3__IGHJ1*01 | 2086 | O12__IGKJ1*01 | 833 | 1438 |
| 18 | VH3-23__IGHD2-21*01>2__IGHJ1*01 | 2087 | O12__IGKJ1*01 | 833 | 1438 |
| 19 | VH3-23__IGHD2-21*01>3__IGHJ1*01 | 2088 | O12__IGKJ1*01 | 833 | 1438 |
| 20 | VH3-23__IGHD3-3*01>1__IGHJ1*01 | 2089 | O12__IGKJ1*01 | 833 | 1438 |
| 21 | VH3-23__IGHD3-3*01>2__IGHJ1*01 | 2090 | O12__IGKJ1*01 | 833 | 1438 |
| 22 | VH3-23__IGHD3-3*01>3__IGHJ1*01 | 2091 | O12__IGKJ1*01 | 833 | 1438 |
| 23 | VH3-23__IGHD3-9*01>2__IGHJ1*01 | 2092 | O12__IGKJ1*01 | 833 | 1438 |
| 24 | VH3-23__IGHD3-10*01>2__IGHJ1*01 | 2093 | O12__IGKJ1*01 | 833 | 1438 |
| 25 | VH3-23__IGHD3-10*01>3__IGHJ1*01 | 2094 | O12__IGKJ1*01 | 833 | 1438 |
| 26 | VH3-23__IGHD3-16*01>2__IGHJ1*01 | 2095 | O12__IGKJ1*01 | 833 | 1438 |
| 27 | VH3-23__IGHD3-16*01>3__IGHJ1*01 | 2096 | O12__IGKJ1*01 | 833 | 1438 |
| 28 | VH3-23__IGHD3-22*01>2__IGHJ1*01 | 2097 | O12__IGKJ1*01 | 833 | 1438 |
| 29 | VH3-23__IGHD3-22*01>3__IGHJ1*01 | 2098 | O12__IGKJ1*01 | 833 | 1438 |
| 30 | VH3-23__IGHD4-4*01 (1) >2__IGHJ1*01 | 2099 | O12__IGKJ1*01 | 833 | 1438 |
| 31 | VH3-23__IGHD4-4*01 (1) >3__IGHJ1*01 | 2100 | O12__IGKJ1*01 | 833 | 1438 |
| 32 | VH3-23__IGHD4-11*01 (1) >2__IGHJ1*01 | 2101 | O12__IGKJ1*01 | 833 | 1438 |
| 33 | VH3-23__IGHD4-11*01 (1) >3__IGHJ1*01 | 2102 | O12__IGKJ1*01 | 833 | 1438 |
| 34 | VH3-23__IGHD4-17*01>2__IGHJ1*01 | 2103 | O12__IGKJ1*01 | 833 | 1438 |
| 35 | VH3-23__IGHD4-17*01>3__IGHJ1*01 | 2104 | O12__IGKJ1*01 | 833 | 1438 |
| 36 | VH3-23__IGHD4-23*01>2__IGHJ1*01 | 2105 | O12__IGKJ1*01 | 833 | 1438 |
| 37 | VH3-23__IGHD4-23*01>3__IGHJ1*01 | 2106 | O12__IGKJ1*01 | 833 | 1438 |
| 38 | VH3-23__IGHD5-5*01 (2) >1__IGHJ1*01 | 2107 | O12__IGKJ1*01 | 833 | 1438 |
| 39 | VH3-23__IGHD5-5*01 (2) >2__IGHJ1*01 | 2108 | O12__IGKJ1*01 | 833 | 1438 |
| 40 | VH3-23__IGHD5-5*01 (2) >3__IGHJ1*01 | 2109 | O12__IGKJ1*01 | 833 | 1438 |
| 41 | VH3-23__IGHD5-12*01>1__IGHJ1*01 | 2110 | O12__IGKJ1*01 | 833 | 1438 |
| 42 | VH3-23__IGHD5-12*01>3__IGHJ1*01 | 2111 | O12__IGKJ1*01 | 833 | 1438 |
| 43 | VH3-23__IGHD5-18*01 (2) >1__IGHJ1*01 | 2112 | O12__IGKJ1*01 | 833 | 1438 |
| 44 | VH3-23__IGHD5-18*01 (2) >2__IGHJ1*01 | 2113 | O12__IGKJ1*01 | 833 | 1438 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 45 | VH3-23_IGHD5-18*01 (2) >3'_IGHJ1*01 | 2114 | O12_IGKJ1*01 | 833 | 1438 |
| 46 | VH3-23_IGHD5-24*01>1'_IGHJ1*01 | 2115 | O12_IGKJ1*01 | 833 | 1438 |
| 47 | VH3-23_IGHD5-24*01>3'_IGHJ1*01 | 2116 | O12_IGKJ1*01 | 833 | 1438 |
| 48 | VH3-23_IGHD6-6*01>1'_IGHJ1*01 | 2117 | O12_IGKJ1*01 | 833 | 1438 |
| 49 | VH3-23_IGHD1-1*01>1'_IGHJ1*01 | 2127 | O12_IGKJ1*01 | 833 | 1438 |
| 50 | VH3-23_IGHD1-1*01>2'_IGHJ1*01 | 2128 | O12_IGKJ1*01 | 833 | 1438 |
| 51 | VH3-23_IGHD1-1*01>3'_IGHJ1*01 | 2129 | O12_IGKJ1*01 | 833 | 1438 |
| 52 | VH3-23_IGHD1-7*01>1'_IGHJ1*01 | 2130 | O12_IGKJ1*01 | 833 | 1438 |
| 53 | VH3-23_IGHD1-7*01>3'_IGHJ1*01 | 2131 | O12_IGKJ1*01 | 833 | 1438 |
| 54 | VH3-23_IGHD1-14*01>1'_IGHJ1*01 | 2132 | O12_IGKJ1*01 | 833 | 1438 |
| 55 | VH3-23_IGHD1-14*01>2'_IGHJ1*01 | 2133 | O12_IGKJ1*01 | 833 | 1438 |
| 56 | VH3-23_IGHD1-14*01>3'_IGHJ1*01 | 2134 | O12_IGKJ1*01 | 833 | 1438 |
| 57 | VH3-23_IGHD1-20*01>1'_IGHJ1*01 | 2135 | O12_IGKJ1*01 | 833 | 1438 |
| 58 | VH3-23_IGHD1-20*01>2'_IGHJ1*01 | 2136 | O12_IGKJ1*01 | 833 | 1438 |
| 59 | VH3-23_IGHD1-20*01>3'_IGHJ1*01 | 2137 | O12_IGKJ1*01 | 833 | 1438 |
| 60 | VH3-23_IGHD1-26*01>1'_IGHJ1*01 | 2138 | O12_IGKJ1*01 | 833 | 1438 |
| 61 | VH3-23_IGHD1-26*01>3'_IGHJ1*01 | 2139 | O12_IGKJ1*01 | 833 | 1438 |
| 62 | VH3-23_IGHD2-2*01>1'_IGHJ1*01 | 2140 | O12_IGKJ1*01 | 833 | 1438 |
| 63 | VH3-23_IGHD2-2*01>3'_IGHJ1*01 | 2141 | O12_IGKJ1*01 | 833 | 1438 |
| 64 | VH3-23_IGHD2-8*01>1'_IGHJ1*01 | 2142 | O12_IGKJ1*01 | 833 | 1438 |
| 65 | VH3-23_IGHD2-15*01>1'_IGHJ1*01 | 2143 | O12_IGKJ1*01 | 833 | 1438 |
| 66 | VH3-23_IGHD2-15*01>3'_IGHJ1*01 | 2144 | O12_IGKJ1*01 | 833 | 1438 |
| 67 | VH3-23_IGHD2-21*01>1'_IGHJ1*01 | 2145 | O12_IGKJ1*01 | 833 | 1438 |
| 68 | VH3-23_IGHD2-21*01>3'_IGHJ1*01 | 2146 | O12_IGKJ1*01 | 833 | 1438 |
| 69 | VH3-23_IGHD3-3*01>1'_IGHJ1*01 | 2147 | O12_IGKJ1*01 | 833 | 1438 |
| 70 | VH3-23_IGHD3-3*01>3'_IGHJ1*01 | 2148 | O12_IGKJ1*01 | 833 | 1438 |
| 71 | VH3-23_IGHD3-9*01>1'_IGHJ1*01 | 2149 | O12_IGKJ1*01 | 833 | 1438 |
| 72 | VH3-23_IGHD3-9*01>3'_IGHJ1*01 | 2150 | O12_IGKJ1*01 | 833 | 1438 |
| 73 | VH3-23_IGHD3-10*01>1'_IGHJ1*01 | 2151 | O12_IGKJ1*01 | 833 | 1438 |
| 74 | VH3-23_IGHD3-10*01>3'_IGHJ1*01 | 2152 | O12_IGKJ1*01 | 833 | 1438 |
| 75 | VH3-23_IGHD3-16*01>1'_IGHJ1*01 | 2153 | O12_IGKJ1*01 | 833 | 1438 |
| 76 | VH3-23_IGHD3-16*01>3'_IGHJ1*01 | 2154 | O12_IGKJ1*01 | 833 | 1438 |
| 77 | VH3-23_IGHD3-22*01>1'_IGHJ1*01 | 2155 | O12_IGKJ1*01 | 833 | 1438 |
| 78 | VH3-23_IGHD4-4*01 (1) >1'_IGHJ1*01 | 2156 | O12_IGKJ1*01 | 833 | 1438 |
| 79 | VH3-23_IGHD4-4*01 (1) >3'_IGHJ1*01 | 2157 | O12_IGKJ1*01 | 833 | 1438 |
| 80 | VH3-23_IGHD4-11*01 (1) >1'_IGHJ1*01 | 2158 | O12_IGKJ1*01 | 833 | 1438 |
| 81 | VH3-23_IGHD4-11*01 (1) >3'_IGHJ1*01 | 2159 | O12_IGKJ1*01 | 833 | 1438 |
| 82 | VH3-23_IGHD4-17*01>1'_IGHJ1*01 | 2160 | O12_IGKJ1*01 | 833 | 1438 |
| 83 | VH3-23_IGHD4-17*01>3'_IGHJ1*01 | 2161 | O12_IGKJ1*01 | 833 | 1438 |
| 84 | VH3-23_IGHD4-23*01>1'_IGHJ1*01 | 2162 | O12_IGKJ1*01 | 833 | 1438 |
| 85 | VH3-23_IGHD4-23*01>3'_IGHJ1*01 | 2163 | O12_IGKJ1*01 | 833 | 1438 |
| 86 | VH3-23_IGHD5-5*01 (2) >1'_IGHJ1*01 | 2164 | O12_IGKJ1*01 | 833 | 1438 |
| 87 | VH3-23_IGHD5-5*01 (2) >3'_IGHJ1*01 | 2165 | O12_IGKJ1*01 | 833 | 1438 |
| 88 | VH3-23_IGHD5-12*01>1'_IGHJ1*01 | 2166 | O12_IGKJ1*01 | 833 | 1438 |
| 89 | VH3-23_IGHD5-12*01>3'_IGHJ1*01 | 2167 | O12_IGKJ1*01 | 833 | 1438 |
| 90 | VH3-23_IGHD5-18*01 (2) >1'_IGHJ1*01 | 2168 | O12_IGKJ1*01 | 833 | 1438 |
| 91 | VH3-23_IGHD5-18*01 (2) >3'_IGHJ1*01 | 2169 | O12_IGKJ1*01 | 833 | 1438 |
| 92 | VH3-23_IGHD5-24*01>1'_IGHJ1*01 | 2170 | O12_IGKJ1*01 | 833 | 1438 |
| 93 | VH3-23_IGHD5-24*01>3'_IGHJ1*01 | 2171 | O12_IGKJ1*01 | 833 | 1438 |
| 94 | VH3-23_IGHD6-6*01>1'_IGHJ1*01 | 2172 | O12_IGKJ1*01 | 833 | 1438 |
| 95 | VH3-23_IGHD6-6*01>2'_IGHJ1*01 | 2173 | O12_IGKJ1*01 | 833 | 1438 |
| 96 | VH3-23_IGHD6-6*01>3'_IGHJ1*01 | 2174 | O12_IGKJ1*01 | 833 | 1438 |
| 97 | VH3-23_IGHD6-6*01>2_IGHJ1*01 | 2118 | O12_IGKJ1*01 | 833 | 1438 |
| 98 | VH3-23_IGHD6-13*01>1_IGHJ1*01 | 2119 | O12_IGKJ1*01 | 833 | 1438 |
| 99 | VH3-23_IGHD6-13*01>2_IGHJ1*01 | 2120 | O12_IGKJ1*01 | 833 | 1438 |
| 100 | VH3-23_IGHD6-19*01>1_IGHJ1*01 | 2121 | O12_IGKJ1*01 | 833 | 1438 |
| 101 | VH3-23_IGHD6-19*01>2_IGHJ1*01 | 2122 | O12_IGKJ1*01 | 833 | 1438 |
| 102 | VH3-23_IGHD6-25*01>1_IGHJ1*01 | 2123 | O12_IGKJ1*01 | 833 | 1438 |
| 103 | VH3-23_IGHD6-25*01>2_IGHJ1*01 | 2124 | O12_IGKJ1*01 | 833 | 1438 |
| 104 | VH3-23_IGHD7-27*01>1_IGHJ1*01 | 2125 | O12_IGKJ1*01 | 833 | 1438 |
| 105 | VH3-23_IGHD7-27*01>3_IGHJ1*01 | 2126 | O12_IGKJ1*01 | 833 | 1438 |
| 106 | VH3-23_IGHD6-13*01>1'_IGHJ1*01 | 2175 | O12_IGKJ1*01 | 833 | 1438 |
| 107 | VH3-23_IGHD6-13*01>2'_IGHJ1*01 | 2176 | O12_IGKJ1*01 | 833 | 1438 |
| 108 | VH3-23_IGHD6-13*01>2'_IGHJ1*01_B | 2177 | O12_IGKJ1*01 | 833 | 1438 |
| 109 | VH3-23_IGHD6-19*01>1'_IGHJ1*01 | 2178 | O12_IGKJ1*01 | 833 | 1438 |
| 110 | VH3-23_IGHD6-19*01>2'_IGHJ1*01 | 2179 | O12_IGKJ1*01 | 833 | 1438 |
| 111 | VH3-23_IGHD6-19*01>2'_IGHJ1*01_B | 2180 | O12_IGKJ1*01 | 833 | 1438 |
| 112 | VH3-23_IGHD6-25*01>1'_IGHJ1*01 | 2181 | O12_IGKJ1*01 | 833 | 1438 |
| 113 | VH3-23_IGHD6-25*01>3'_IGHJ1*01 | 2182 | O12_IGKJ1*01 | 833 | 1438 |
| 114 | VH3-23_IGHD7-27*01>1'_IGHJ1*01_B | 2183 | O12_IGKJ1*01 | 833 | 1438 |
| 115 | VH3-23_IGHD7-27*01>2'_IGHJ1*01 | 2184 | O12_IGKJ1*01 | 833 | 1438 |
| 116 | VH3-23_IGHD1-1*01>1_IGHJ2*01 | 2185 | O12_IGKJ1*01 | 833 | 1438 |
| 117 | VH3-23_IGHD1-1*01>2_IGHJ2*01 | 2186 | O12_IGKJ1*01 | 833 | 1438 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 118 | VH3-23_IGHD1-1*01>3_IGHJ2*01 | 2187 | O12_IGKJ1*01 | 833 | 1438 |
| 119 | VH3-23_IGHD1-7*01>1_IGHJ2*01 | 2188 | O12_IGKJ1*01 | 833 | 1438 |
| 120 | VH3-23_IGHD1-7*01>3_IGHJ2*01 | 2189 | O12_IGKJ1*01 | 833 | 1438 |
| 121 | VH3-23_IGHD1-14*01>1_IGHJ2*01 | 2190 | O12_IGKJ1*01 | 833 | 1438 |
| 122 | VH3-23_IGHD1-14*01>3_IGHJ2*01 | 2191 | O12_IGKJ1*01 | 833 | 1438 |
| 123 | VH3-23_IGHD1-20*01>1_IGHJ2*01 | 2192 | O12_IGKJ1*01 | 833 | 1438 |
| 124 | VH3-23_IGHD1-20*01>3_IGHJ2*01 | 2193 | O12_IGKJ1*01 | 833 | 1438 |
| 125 | VH3-23_IGHD1-26*01>1_IGHJ2*01 | 2194 | O12_IGKJ1*01 | 833 | 1438 |
| 126 | VH3-23_IGHD1-26*01>3_IGHJ2*01 | 2195 | O12_IGKJ1*01 | 833 | 1438 |
| 127 | VH3-23_IGHD2-2*01>2_IGHJ2*01 | 2196 | O12_IGKJ1*01 | 833 | 1438 |
| 128 | VH3-23_IGHD2-2*01>3_IGHJ2*01 | 2197 | O12_IGKJ1*01 | 833 | 1438 |
| 129 | VH3-23_IGHD2-8*01>2_IGHJ2*01 | 2198 | O12_IGKJ1*01 | 833 | 1438 |
| 130 | VH3-23_IGHD2-8*01>3_IGHJ2*01 | 2199 | O12_IGKJ1*01 | 833 | 1438 |
| 131 | VH3-23_IGHD2-15*01>2_IGHJ2*01 | 2200 | O12_IGKJ1*01 | 833 | 1438 |
| 132 | VH3-23_IGHD2-15*01>3_IGHJ2*01 | 2201 | O12_IGKJ1*01 | 833 | 1438 |
| 133 | VH3-23_IGHD2-21*01>2_IGHJ2*01 | 2202 | O12_IGKJ1*01 | 833 | 1438 |
| 134 | VH3-23_IGHD2-21*01>3_IGHJ2*01 | 2203 | O12_IGKJ1*01 | 833 | 1438 |
| 135 | VH3-23_IGHD3-3*01>1_IGHJ2*01 | 2204 | O12_IGKJ1*01 | 833 | 1438 |
| 136 | VH3-23_IGHD3-3*01>2_IGHJ2*01 | 2205 | O12_IGKJ1*01 | 833 | 1438 |
| 137 | VH3-23_IGHD3-3*01>3_IGHJ2*01 | 2206 | O12_IGKJ1*01 | 833 | 1438 |
| 138 | VH3-23_IGHD3-9*01>2_IGHJ2*01 | 2207 | O12_IGKJ1*01 | 833 | 1438 |
| 139 | VH3-23_IGHD3-10*01>2_IGHJ2*01 | 2208 | O12_IGKJ1*01 | 833 | 1438 |
| 140 | VH3-23_IGHD3-10*01>3_IGHJ2*01 | 2209 | O12_IGKJ1*01 | 833 | 1438 |
| 141 | VH3-23_IGHD3-16*01>2_IGHJ2*01 | 2210 | O12_IGKJ1*01 | 833 | 1438 |
| 142 | VH3-23_IGHD3-16*01>3_IGHJ2*01 | 2211 | O12_IGKJ1*01 | 833 | 1438 |
| 143 | VH3-23_IGHD3-22*01>2_IGHJ2*01 | 2212 | O12_IGKJ1*01 | 833 | 1438 |
| 144 | VH3-23_IGHD3-22*01>3_IGHJ2*01 | 2213 | O12_IGKJ1*01 | 833 | 1438 |
| 145 | VH3-23_IGHD4-4*01 (1) >2_IGHJ2*01 | 2214 | O12_IGKJ1*01 | 833 | 1438 |
| 146 | VH3-23_IGHD4-4*01 (1) >3_IGHJ2*01 | 2215 | O12_IGKJ1*01 | 833 | 1438 |
| 147 | VH3-23_IGHD4-11*01 (1) >2_IGHJ2*01 | 2216 | O12_IGKJ1*01 | 833 | 1438 |
| 148 | VH3-23_IGHD4-11*01 (1) >3_IGHJ2*01 | 2217 | O12_IGKJ1*01 | 833 | 1438 |
| 149 | VH3-23_IGHD4-17*01>2_IGHJ2*01 | 2218 | O12_IGKJ1*01 | 833 | 1438 |
| 150 | VH3-23_IGHD4-17*01>3_IGHJ2*01 | 2219 | O12_IGKJ1*01 | 833 | 1438 |
| 151 | VH3-23_IGHD4-23*01>2_IGHJ2*01 | 2220 | O12_IGKJ1*01 | 833 | 1438 |
| 152 | VH3-23_IGHD4-23*01>3_IGHJ2*01 | 2221 | O12_IGKJ1*01 | 833 | 1438 |
| 153 | VH3-23_IGHD5-5*01 (2) >1_IGHJ2*01 | 2222 | O12_IGKJ1*01 | 833 | 1438 |
| 154 | VH3-23_IGHD5-5*01 (2) >2_IGHJ2*01 | 2223 | O12_IGKJ1*01 | 833 | 1438 |
| 155 | VH3-23_IGHD5-5*01 (2) >3_IGHJ2*01 | 2224 | O12_IGKJ1*01 | 833 | 1438 |
| 156 | VH3-23_IGHD5-12*01>1_IGHJ2*01 | 2225 | O12_IGKJ1*01 | 833 | 1438 |
| 157 | VH3-23_IGHD5-12*01>3_IGHJ2*01 | 2226 | O12_IGKJ1*01 | 833 | 1438 |
| 158 | VH3-23_IGHD5-18*01 (2) >1_IGHJ2*01 | 2227 | O12_IGKJ1*01 | 833 | 1438 |
| 159 | VH3-23_IGHD5-18*01 (2) >2_IGHJ2*01 | 2228 | O12_IGKJ1*01 | 833 | 1438 |
| 160 | VH3-23_IGHD5-18*01 (2) >3_IGHJ2*01 | 2229 | O12_IGKJ1*01 | 833 | 1438 |
| 161 | VH3-23_IGHD5-24*01>1_IGHJ2*01 | 2230 | O12_IGKJ1*01 | 833 | 1438 |
| 162 | VH3-23_IGHD5-24*01>3_IGHJ2*01 | 2231 | O12_IGKJ1*01 | 833 | 1438 |
| 163 | VH3-23_IGHD6-6*01>1_IGHJ2*01 | 2232 | O12_IGKJ1*01 | 833 | 1438 |
| 164 | VH3-23_IGHD1-1*01>1'_IGHJ2*01 | 2242 | O12_IGKJ1*01 | 833 | 1438 |
| 165 | VH3-23_IGHD1-1*01>2'_IGHJ2*01 | 2243 | O12_IGKJ1*01 | 833 | 1438 |
| 166 | VH3-23_IGHD1-1*01>3'_IGHJ2*01 | 2244 | O12_IGKJ1*01 | 833 | 1438 |
| 167 | VH3-23_IGHD1-7*01>1'_IGHJ2*01 | 2245 | O12_IGKJ1*01 | 833 | 1438 |
| 168 | VH3-23_IGHD1-7*01>3'_IGHJ2*01 | 2246 | O12_IGKJ1*01 | 833 | 1438 |
| 169 | VH3-23_IGHD1-14*01>1'_IGHJ2*01 | 2247 | O12_IGKJ1*01 | 833 | 1438 |
| 170 | VH3-23_IGHD1-14*01>2'_IGHJ2*01 | 2248 | O12_IGKJ1*01 | 833 | 1438 |
| 171 | VH3-23_IGHD1-14*01>3'_IGHJ2*01 | 2249 | O12_IGKJ1*01 | 833 | 1438 |
| 172 | VH3-23_IGHD1-20*01>1'_IGHJ2*01 | 2250 | O12_IGKJ1*01 | 833 | 1438 |
| 173 | VH3-23_IGHD1-20*01>2'_IGHJ2*01 | 2251 | O12_IGKJ1*01 | 833 | 1438 |
| 174 | VH3-23_IGHD1-20*01>3'_IGHJ2*01 | 2252 | O12_IGKJ1*01 | 833 | 1438 |
| 175 | VH3-23_IGHD1-26*01>1'_IGHJ2*01 | 2253 | O12_IGKJ1*01 | 833 | 1438 |
| 176 | VH3-23_IGHD1-26*01>1'_IGHJ2*01_B | 2254 | O12_IGKJ1*01 | 833 | 1438 |
| 177 | VH3-23_IGHD2-2*01>1'_IGHJ2*01 | 2255 | O12_IGKJ1*01 | 833 | 1438 |
| 178 | VH3-23_IGHD2-2*01>3'_IGHJ2*01 | 2256 | O12_IGKJ1*01 | 833 | 1438 |
| 179 | VH3-23_IGHD2-8*01>1'_IGHJ2*01 | 2257 | O12_IGKJ1*01 | 833 | 1438 |
| 180 | VH3-23_IGHD2-15*01>1'_IGHJ2*01 | 2258 | O12_IGKJ1*01 | 833 | 1438 |
| 181 | VH3-23_IGHD2-15*01>3'_IGHJ2*01 | 2259 | O12_IGKJ1*01 | 833 | 1438 |
| 182 | VH3-23_IGHD2-21*01>1'_IGHJ2*01 | 2260 | O12_IGKJ1*01 | 833 | 1438 |
| 183 | VH3-23_IGHD2-21*01>3'_IGHJ2*01 | 2261 | O12_IGKJ1*01 | 833 | 1438 |
| 184 | VH3-23_IGHD3-3*01>1'_IGHJ2*01 | 2262 | O12_IGKJ1*01 | 833 | 1438 |
| 185 | VH3-23_IGHD3-3*01>3'_IGHJ2*01 | 2263 | O12_IGKJ1*01 | 833 | 1438 |
| 186 | VH3-23_IGHD3-9*01>1'_IGHJ2*01 | 2264 | O12_IGKJ1*01 | 833 | 1438 |
| 187 | VH3-23_IGHD3-9*01>3'_IGHJ2*01 | 2265 | O12_IGKJ1*01 | 833 | 1438 |
| 188 | VH3-23_IGHD3-10*01>1'_IGHJ2*01 | 2266 | O12_IGKJ1*01 | 833 | 1438 |
| 189 | VH3-23_IGHD3-10*01>3'_IGHJ2*01 | 2267 | O12_IGKJ1*01 | 833 | 1438 |
| 190 | VH3-23_IGHD3-16*01>1'_IGHJ2*01 | 2268 | O12_IGKJ1*01 | 833 | 1438 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 191 | VH3-23_IGHD3-16*01>3'_IGHJ2*01 | 2269 | O12_IGKJ1*01 | 833 | 1438 |
| 192 | VH3-23_IGHD3-22*01>1'_IGHJ2*01 | 2270 | O12_IGKJ1*01 | 833 | 1438 |
| 193 | VH3-23_IGHD4-4*01 (1) >1'_IGHJ2*01 | 2271 | O12_IGKJ1*01 | 833 | 1438 |
| 194 | VH3-23_IGHD4-4*01 (1) >3'_IGHJ2*01 | 2272 | O12_IGKJ1*01 | 833 | 1438 |
| 195 | VH3-23_IGHD4-11*01 (1) >1'_IGHJ2*01 | 2273 | O12_IGKJ1*01 | 833 | 1438 |
| 196 | VH3-23_IGHD4-11*01 (1) >3'_IGHJ2*01 | 2274 | O12_IGKJ1*01 | 833 | 1438 |
| 197 | VH3-23_IGHD4-17*01>1'_IGHJ2*01 | 2275 | O12_IGKJ1*01 | 833 | 1438 |
| 198 | VH3-23_IGHD4-17*01>3'_IGHJ2*01 | 2276 | O12_IGKJ1*01 | 833 | 1438 |
| 199 | VH3-23_IGHD4-23*01>1'_IGHJ2*01 | 2277 | O12_IGKJ1*01 | 833 | 1438 |
| 200 | VH3-23_IGHD4-23*01>3'_IGHJ2*01 | 2278 | O12_IGKJ1*01 | 833 | 1438 |
| 201 | VH3-23_IGHD5-5*01 (2) >1'_IGHJ2*01 | 2279 | O12_IGKJ1*01 | 833 | 1438 |
| 202 | VH3-23_IGHD5-5*01 (2) >3'_IGHJ2*01 | 2280 | O12_IGKJ1*01 | 833 | 1438 |
| 203 | VH3-23_IGHD5-12*01>1'_IGHJ2*01 | 2281 | O12_IGKJ1*01 | 833 | 1438 |
| 204 | VH3-23_IGHD5-12*01>3'_IGHJ2*01 | 2282 | O12_IGKJ1*01 | 833 | 1438 |
| 205 | VH3-23_IGHD5-18*01 (2) >1'_IGHJ2*01 | 2283 | O12_IGKJ1*01 | 833 | 1438 |
| 206 | VH3-23_IGHD5-18*01 (2) >3'_IGHJ2*01 | 2284 | O12_IGKJ1*01 | 833 | 1438 |
| 207 | VH3-23_IGHD5-24*01>1'_IGHJ2*01 | 2285 | O12_IGKJ1*01 | 833 | 1438 |
| 208 | VH3-23_IGHD5-24*01>3'_IGHJ2*01 | 2286 | O12_IGKJ1*01 | 833 | 1438 |
| 209 | VH3-23_IGHD6-6*01>1'_IGHJ2*01 | 2287 | O12_IGKJ1*01 | 833 | 1438 |
| 210 | VH3-23_IGHD6-6*01>2'_IGHJ2*01 | 2288 | O12_IGKJ1*01 | 833 | 1438 |
| 211 | VH3-23_IGHD6-6*01>3'_IGHJ2*01 | 2289 | O12_IGKJ1*01 | 833 | 1438 |
| 212 | VH3-23_IGHD6-6*01>2_IGHJ2*01 | 2233 | O12_IGKJ1*01 | 833 | 1438 |
| 213 | VH3-23_IGHD6-13*01>1_IGHJ2*01 | 2234 | O12_IGKJ1*01 | 833 | 1438 |
| 214 | VH3-23_IGHD6-13*01>2_IGHJ2*01 | 2235 | O12_IGKJ1*01 | 833 | 1438 |
| 215 | VH3-23_IGHD6-19*01>1_IGHJ2*01 | 2236 | O12_IGKJ1*01 | 833 | 1438 |
| 216 | VH3-23_IGHD6-19*01>2_IGHJ2*01 | 2237 | O12_IGKJ1*01 | 833 | 1438 |
| 217 | VH3-23_IGHD6-25*01>1_IGHJ2*01 | 2238 | O12_IGKJ1*01 | 833 | 1438 |
| 218 | VH3-23_IGHD6-25*01>2_IGHJ2*01 | 2239 | O12_IGKJ1*01 | 833 | 1438 |
| 219 | VH3-23_IGHD7-27*01>1_IGHJ2*01 | 2240 | O12_IGKJ1*01 | 833 | 1438 |
| 220 | VH3-23_IGHD7-27*01>3_IGHJ2*01 | 2241 | O12_IGKJ1*01 | 833 | 1438 |
| 221 | VH3-23_IGHD6-13*01>1'_IGHJ2*01 | 2290 | O12_IGKJ1*01 | 833 | 1438 |
| 222 | VH3-23_IGHD6-13*01>2'_IGHJ2*01 | 2291 | O12_IGKJ1*01 | 833 | 1438 |
| 223 | VH3-23_IGHD6-13*01>2'_IGHJ2*01_B | 2292 | O12_IGKJ1*01 | 833 | 1438 |
| 224 | VH3-23_IGHD6-19*01>1'_IGHJ2*01 | 2293 | O12_IGKJ1*01 | 833 | 1438 |
| 225 | VH3-23_IGHD6-19*01>2'_IGHJ2*01 | 2294 | O12_IGKJ1*01 | 833 | 1438 |
| 226 | VH3-23_IGHD6-19*01>2'_IGHJ2*01_B | 2295 | O12_IGKJ1*01 | 833 | 1438 |
| 227 | VH3-23_IGHD6-25*01>1'_IGHJ2*01 | 2296 | O12_IGKJ1*01 | 833 | 1438 |
| 228 | VH3-23_IGHD6-25*01>3'_IGHJ2*01 | 2297 | O12_IGKJ1*01 | 833 | 1438 |
| 229 | VH3-23_IGHD7-27*01>1'_IGHJ2*01 | 2298 | O12_IGKJ1*01 | 833 | 1438 |
| 230 | VH3-23_IGHD7-27*01>2'_IGHJ2*01 | 2299 | O12_IGKJ1*01 | 833 | 1438 |
| 231 | VH3-23_IGHD1-1*01>1_IGHJ3*01 | 2300 | O12_IGKJ1*01 | 833 | 1438 |
| 232 | VH3-23_IGHD1-1*01>2_IGHJ3*01 | 2301 | O12_IGKJ1*01 | 833 | 1438 |
| 233 | VH3-23_IGHD1-1*01>3_IGHJ3*01 | 2302 | O12_IGKJ1*01 | 833 | 1438 |
| 234 | VH3-23_IGHD1-7*01>1_IGHJ3*01 | 2303 | O12_IGKJ1*01 | 833 | 1438 |
| 235 | VH3-23_IGHD1-7*01>3_IGHJ3*01 | 2304 | O12_IGKJ1*01 | 833 | 1438 |
| 236 | VH3-23_IGHD1-14*01>1_IGHJ3*01 | 2305 | O12_IGKJ1*01 | 833 | 1438 |
| 237 | VH3-23_IGHD1-14*01>3_IGHJ3*01 | 2306 | O12_IGKJ1*01 | 833 | 1438 |
| 238 | VH3-23_IGHD1-20*01>1_IGHJ3*01 | 2307 | O12_IGKJ1*01 | 833 | 1438 |
| 239 | VH3-23_IGHD1-20*01>3_IGHJ3*01 | 2308 | O12_IGKJ1*01 | 833 | 1438 |
| 240 | VH3-23_IGHD1-26*01>1_IGHJ3*01 | 2309 | O12_IGKJ1*01 | 833 | 1438 |
| 241 | VH3-23_IGHD1-26*01>3_IGHJ3*01 | 2310 | O12_IGKJ1*01 | 833 | 1438 |
| 242 | VH3-23_IGHD2-2*01>2_IGHJ3*01 | 2311 | O12_IGKJ1*01 | 833 | 1438 |
| 243 | VH3-23_IGHD2-2*01>3_IGHJ3*01 | 2312 | O12_IGKJ1*01 | 833 | 1438 |
| 244 | VH3-23_IGHD2-8*01>2_IGHJ3*01 | 2313 | O12_IGKJ1*01 | 833 | 1438 |
| 245 | VH3-23_IGHD2-8*01>3_IGHJ3*01 | 2314 | O12_IGKJ1*01 | 833 | 1438 |
| 246 | VH3-23_IGHD2-15*01>2_IGHJ3*01 | 2315 | O12_IGKJ1*01 | 833 | 1438 |
| 247 | VH3-23_IGHD2-15*01>3_IGHJ3*01 | 2316 | O12_IGKJ1*01 | 833 | 1438 |
| 248 | VH3-23_IGHD2-21*01>2_IGHJ3*01 | 2317 | O12_IGKJ1*01 | 833 | 1438 |
| 249 | VH3-23_IGHD2-21*01>3_IGHJ3*01 | 2318 | O12_IGKJ1*01 | 833 | 1438 |
| 250 | VH3-23_IGHD3-3*01>1_IGHJ3*01 | 2319 | O12_IGKJ1*01 | 833 | 1438 |
| 251 | VH3-23_IGHD3-3*01>2_IGHJ3*01 | 2320 | O12_IGKJ1*01 | 833 | 1438 |
| 252 | VH3-23_IGHD3-3*01>3_IGHJ3*01 | 2321 | O12_IGKJ1*01 | 833 | 1438 |
| 253 | VH3-23_IGHD3-9*01>2_IGHJ3*01 | 2322 | O12_IGKJ1*01 | 833 | 1438 |
| 254 | VH3-23_IGHD3-10*01>2_IGHJ3*01 | 2323 | O12_IGKJ1*01 | 833 | 1438 |
| 255 | VH3-23_IGHD3-10*01>3_IGHJ3*01 | 2324 | O12_IGKJ1*01 | 833 | 1438 |
| 256 | VH3-23_IGHD3-16*01>2_IGHJ3*01 | 2325 | O12_IGKJ1*01 | 833 | 1438 |
| 257 | VH3-23_IGHD3-16*01>3_IGHJ3*01 | 2326 | O12_IGKJ1*01 | 833 | 1438 |
| 258 | VH3-23_IGHD3-22*01>2_IGHJ3*01 | 2327 | O12_IGKJ1*01 | 833 | 1438 |
| 259 | VH3-23_IGHD3-22*01>3_IGHJ3*01 | 2328 | O12_IGKJ1*01 | 833 | 1438 |
| 260 | VH3-23_IGHD4-4*01 (1) >2_IGHJ3*01 | 2329 | O12_IGKJ1*01 | 833 | 1438 |
| 261 | VH3-23_IGHD4-4*01 (1) >3_IGHJ3*01 | 2330 | O12_IGKJ1*01 | 833 | 1438 |
| 262 | VH3-23_IGHD4-11*01 (1) >2_IGHJ3*01 | 2331 | O12_IGKJ1*01 | 833 | 1438 |
| 263 | VH3-23_IGHD4-11*01 (1) >3_IGHJ3*01 | 2332 | O12_IGKJ1*01 | 833 | 1438 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 264 | VH3-23_IGHD4-17*01>2_IGHJ3*01 | 2333 | O12_IGKJ1*01 | 833 | 1438 |
| 265 | VH3-23_IGHD4-17*01>3_IGHJ3*01 | 2334 | O12_IGKJ1*01 | 833 | 1438 |
| 266 | VH3-23_IGHD4-23*01>2_IGHJ3*01 | 2335 | O12_IGKJ1*01 | 833 | 1438 |
| 267 | VH3-23_IGHD4-23*01>3_IGHJ3*01 | 2336 | O12_IGKJ1*01 | 833 | 1438 |
| 268 | VH3-23_IGHD5-5*01 (2) >1_IGHJ3*01 | 2337 | O12_IGKJ1*01 | 833 | 1438 |
| 269 | VH3-23_IGHD5-5*01 (2) >2_IGHJ3*01 | 2338 | O12_IGKJ1*01 | 833 | 1438 |
| 270 | VH3-23_IGHD5-5*01 (2) >3_IGHJ3*01 | 2339 | O12_IGKJ1*01 | 833 | 1438 |
| 271 | VH3-23_IGHD5-12*01>1_IGHJ3*01 | 2340 | O12_IGKJ1*01 | 833 | 1438 |
| 272 | VH3-23_IGHD5-12*01>3_IGHJ3*01 | 2341 | O12_IGKJ1*01 | 833 | 1438 |
| 273 | VH3-23_IGHD5-18*01 (2) >1_IGHJ3*01 | 2342 | O12_IGKJ1*01 | 833 | 1438 |
| 274 | VH3-23_IGHD5-18*01 (2) >2_IGHJ3*01 | 2343 | O12_IGKJ1*01 | 833 | 1438 |
| 275 | VH3-23_IGHD5-18*01 (2) >3_IGHJ3*01 | 2344 | O12_IGKJ1*01 | 833 | 1438 |
| 276 | VH3-23_IGHD5-24*01>1_IGHJ3*01 | 2345 | O12_IGKJ1*01 | 833 | 1438 |
| 277 | VH3-23_IGHD5-24*01>3_IGHJ3*01 | 2346 | O12_IGKJ1*01 | 833 | 1438 |
| 278 | VH3-23_IGHD6-6*01>1_IGHJ3*01 | 2347 | O12_IGKJ1*01 | 833 | 1438 |
| 279 | VH3-23_IGHD1-1*01>1'_IGHJ3*01 | 2357 | O12_IGKJ1*01 | 833 | 1438 |
| 280 | VH3-23_IGHD1-1*01>2'_IGHJ3*01 | 2358 | O12_IGKJ1*01 | 833 | 1438 |
| 281 | VH3-23_IGHD1-1*01>3'_IGHJ3*01 | 2359 | O12_IGKJ1*01 | 833 | 1438 |
| 282 | VH3-23_IGHD1-7*01>1'_IGHJ3*01 | 2360 | O12_IGKJ1*01 | 833 | 1438 |
| 283 | VH3-23_IGHD1-7*01>3'_IGHJ3*01 | 2361 | O12_IGKJ1*01 | 833 | 1438 |
| 284 | VH3-23_IGHD1-14*01>1'_IGHJ3*01 | 2362 | O12_IGKJ1*01 | 833 | 1438 |
| 285 | VH3-23_IGHD1-14*01>2'_IGHJ3*01 | 2363 | O12_IGKJ1*01 | 833 | 1438 |
| 286 | VH3-23_IGHD1-14*01>3'_IGHJ3*01 | 2364 | O12_IGKJ1*01 | 833 | 1438 |
| 287 | VH3-23_IGHD1-20*01>1'_IGHJ3*01 | 2365 | O12_IGKJ1*01 | 833 | 1438 |
| 288 | VH3-23_IGHD1-20*01>2'_IGHJ3*01 | 2366 | O12_IGKJ1*01 | 833 | 1438 |
| 289 | VH3-23_IGHD1-20*01>3'_IGHJ3*01 | 2367 | O12_IGKJ1*01 | 833 | 1438 |
| 290 | VH3-23_IGHD1-26*01>1'_IGHJ3*01 | 2368 | O12_IGKJ1*01 | 833 | 1438 |
| 291 | VH3-23_IGHD1-26*01>3'_IGHJ3*01 | 2369 | O12_IGKJ1*01 | 833 | 1438 |
| 292 | VH3-23_IGHD2-2*01>1'_IGHJ3*01 | 2370 | O12_IGKJ1*01 | 833 | 1438 |
| 293 | VH3-23_IGHD2-2*01>3'_IGHJ3*01 | 2371 | O12_IGKJ1*01 | 833 | 1438 |
| 294 | VH3-23_IGHD2-8*01>1'_IGHJ3*01 | 2372 | O12_IGKJ1*01 | 833 | 1438 |
| 295 | VH3-23_IGHD2-15*01>1'_IGHJ3*01 | 2373 | O12_IGKJ1*01 | 833 | 1438 |
| 296 | VH3-23_IGHD2-15*01>3'_IGHJ3*01 | 2374 | O12_IGKJ1*01 | 833 | 1438 |
| 297 | VH3-23_IGHD2-21*01>1'_IGHJ3*01 | 2375 | O12_IGKJ1*01 | 833 | 1438 |
| 298 | VH3-23_IGHD2-21*01>3'_IGHJ3*01 | 2376 | O12_IGKJ1*01 | 833 | 1438 |
| 299 | VH3-23_IGHD3-3*01>1'_IGHJ3*01 | 2377 | O12_IGKJ1*01 | 833 | 1438 |
| 300 | VH3-23_IGHD3-3*01>3'_IGHJ3*01 | 2378 | O12_IGKJ1*01 | 833 | 1438 |
| 301 | VH3-23_IGHD3-9*01>1'_IGHJ3*01 | 2379 | O12_IGKJ1*01 | 833 | 1438 |
| 302 | VH3-23_IGHD3-9*01>3'_IGHJ3*01 | 2380 | O12_IGKJ1*01 | 833 | 1438 |
| 303 | VH3-23_IGHD3-10*01>1'_IGHJ3*01 | 2381 | O12_IGKJ1*01 | 833 | 1438 |
| 304 | VH3-23_IGHD3-10*01>3'_IGHJ3*01 | 2382 | O12_IGKJ1*01 | 833 | 1438 |
| 305 | VH3-23_IGHD3-16*01>1'_IGHJ3*01 | 2383 | O12_IGKJ1*01 | 833 | 1438 |
| 306 | VH3-23_IGHD3-16*01>3'_IGHJ3*01 | 2384 | O12_IGKJ1*01 | 833 | 1438 |
| 307 | VH3-23_IGHD3-22*01>1'_IGHJ3*01 | 2385 | O12_IGKJ1*01 | 833 | 1438 |
| 308 | VH3-23_IGHD4-4*01 (1) >1'_IGHJ3*01 | 2386 | O12_IGKJ1*01 | 833 | 1438 |
| 309 | VH3-23_IGHD4-4*01 (1) >3'_IGHJ3*01 | 2387 | O12_IGKJ1*01 | 833 | 1438 |
| 310 | VH3-23_IGHD4-11*01 (1) >1'_IGHJ3*01 | 2388 | O12_IGKJ1*01 | 833 | 1438 |
| 311 | VH3-23_IGHD4-11*01 (1) >3'_IGHJ3*01 | 2389 | O12_IGKJ1*01 | 833 | 1438 |
| 312 | VH3-23_IGHD4-17*01>1'_IGHJ3*01 | 2390 | O12_IGKJ1*01 | 833 | 1438 |
| 313 | VH3-23_IGHD4-17*01>3'_IGHJ3*01 | 2391 | O12_IGKJ1*01 | 833 | 1438 |
| 314 | VH3-23_IGHD4-23*01>1'_IGHJ3*01 | 2392 | O12_IGKJ1*01 | 833 | 1438 |
| 315 | VH3-23_IGHD4-23*01>3'_IGHJ3*01 | 2393 | O12_IGKJ1*01 | 833 | 1438 |
| 316 | VH3-23_IGHD5-5*01 (2) >1'_IGHJ3*01 | 2394 | O12_IGKJ1*01 | 833 | 1438 |
| 317 | VH3-23_IGHD5-5*01 (2) >3'_IGHJ3*01 | 2395 | O12_IGKJ1*01 | 833 | 1438 |
| 318 | VH3-23_IGHD5-12*01>1'_IGHJ3*01 | 2396 | O12_IGKJ1*01 | 833 | 1438 |
| 319 | VH3-23_IGHD5-12*01>3'_IGHJ3*01 | 2397 | O12_IGKJ1*01 | 833 | 1438 |
| 320 | VH3-23_IGHD5-18*01 (2) >1'_IGHJ3*01 | 2398 | O12_IGKJ1*01 | 833 | 1438 |
| 321 | VH3-23_IGHD5-18*01 (2) >3'_IGHJ3*01 | 2399 | O12_IGKJ1*01 | 833 | 1438 |
| 322 | VH3-23_IGHD5-24*01>1'_IGHJ3*01 | 2400 | O12_IGKJ1*01 | 833 | 1438 |
| 323 | VH3-23_IGHD5-24*01>3'_IGHJ3*01 | 2401 | O12_IGKJ1*01 | 833 | 1438 |
| 324 | VH3-23_IGHD6-6*01>1'_IGHJ3*01 | 2402 | O12_IGKJ1*01 | 833 | 1438 |
| 325 | VH3-23_IGHD6-6*01>2'_IGHJ3*01 | 2403 | O12_IGKJ1*01 | 833 | 1438 |
| 326 | VH3-23_IGHD6-6*01>3'_IGHJ3*01 | 2404 | O12_IGKJ1*01 | 833 | 1438 |
| 327 | VH3-23_IGHD6-6*01>2_IGHJ3*01 | 2348 | O12_IGKJ1*01 | 833 | 1438 |
| 328 | VH3-23_IGHD6-13*01>1_IGHJ3*01 | 2349 | O12_IGKJ1*01 | 833 | 1438 |
| 329 | VH3-23_IGHD6-13*01>2_IGHJ3*01 | 2350 | O12_IGKJ1*01 | 833 | 1438 |
| 330 | VH3-23_IGHD6-19*01>1_IGHJ3*01 | 2351 | O12_IGKJ1*01 | 833 | 1438 |
| 331 | VH3-23_IGHD6-19*01>2_IGHJ3*01 | 2352 | O12_IGKJ1*01 | 833 | 1438 |
| 332 | VH3-23_IGHD6-25*01>1_IGHJ3*01 | 2353 | O12_IGKJ1*01 | 833 | 1438 |
| 333 | VH3-23_IGHD6-25*01>2_IGHJ3*01 | 2354 | O12_IGKJ1*01 | 833 | 1438 |
| 334 | VH3-23_IGHD7-27*01>1_IGHJ3*01 | 2355 | O12_IGKJ1*01 | 833 | 1438 |
| 335 | VH3-23_IGHD7-27*01>3_IGHJ3*01 | 2356 | O12_IGKJ1*01 | 833 | 1438 |
| 336 | VH3-23_IGHD6-13*01>1'_IGHJ3*01 | 2405 | O12_IGKJ1*01 | 833 | 1438 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 337 | VH3-23_IGHD6-13*01>2'_IGHJ3*01 | 2406 | O12_IGKJ1*01 | 833 | 1438 |
| 338 | VH3-23_IGHD6-13*01>1_IGHJ6*01 | 2407 | O12_IGKJ1*01 | 833 | 1438 |
| 339 | VH3-23_IGHD6-19*01>1'_IGHJ3*01 | 2408 | O12_IGKJ1*01 | 833 | 1438 |
| 340 | VH3-23_IGHD6-19*01>2'_IGHJ3*01 | 2409 | O12_IGKJ1*01 | 833 | 1438 |
| 341 | VH3-23_IGHD6-19*01>3'_IGHJ3*01 | 2410 | O12_IGKJ1*01 | 833 | 1438 |
| 342 | VH3-23_IGHD6-25*01>1'_IGHJ3*01 | 2411 | O12_IGKJ1*01 | 833 | 1438 |
| 343 | VH3-23_IGHD6-25*01>3'_IGHJ3*01 | 2412 | O12_IGKJ1*01 | 833 | 1438 |
| 344 | VH3-23_IGHD7-27*01>1'_IGHJ3*01 | 2413 | O12_IGKJ1*01 | 833 | 1438 |
| 345 | VH3-23_IGHD7-27*01>2'_IGHJ3*01 | 2414 | O12_IGKJ1*01 | 833 | 1438 |
| 346 | VH3-23_IGHD1-1*01>1_IGHJ4*01 | 2415 | O12_IGKJ1*01 | 833 | 1438 |
| 347 | VH3-23_IGHD1-1*01>2_IGHJ4*01 | 2416 | O12_IGKJ1*01 | 833 | 1438 |
| 348 | VH3-23_IGHD1-1*01>3_IGHJ4*01 | 2417 | O12_IGKJ1*01 | 833 | 1438 |
| 349 | VH3-23_IGHD1-7*01>1_IGHJ4*01 | 2418 | O12_IGKJ1*01 | 833 | 1438 |
| 350 | VH3-23_IGHD1-7*01>3_IGHJ4*01 | 2419 | O12_IGKJ1*01 | 833 | 1438 |
| 351 | VH3-23_IGHD1-14*01>1_IGHJ4*01 | 2420 | O12_IGKJ1*01 | 833 | 1438 |
| 352 | VH3-23_IGHD1-14*01>3_IGHJ4*01 | 2421 | O12_IGKJ1*01 | 833 | 1438 |
| 353 | VH3-23_IGHD1-20*01>1_IGHJ4*01 | 2422 | O12_IGKJ1*01 | 833 | 1438 |
| 354 | VH3-23_IGHD1-20*01>3_IGHJ4*01 | 2423 | O12_IGKJ1*01 | 833 | 1438 |
| 355 | VH3-23_IGHD1-26*01>1_IGHJ4*01 | 2424 | O12_IGKJ1*01 | 833 | 1438 |
| 356 | VH3-23_IGHD1-26*01>3_IGHJ4*01 | 2425 | O12_IGKJ1*01 | 833 | 1438 |
| 357 | VH3-23_IGHD2-2*01>2_IGHJ4*01 | 2426 | O12_IGKJ1*01 | 833 | 1438 |
| 358 | VH3-23_IGHD2-2*01>3_IGHJ4*01 | 2427 | O12_IGKJ1*01 | 833 | 1438 |
| 359 | VH3-23_IGHD2-8*01>2_IGHJ4*01 | 2428 | O12_IGKJ1*01 | 833 | 1438 |
| 360 | VH3-23_IGHD2-8*01>3_IGHJ4*01 | 2429 | O12_IGKJ1*01 | 833 | 1438 |
| 361 | VH3-23_IGHD2-15*01>2_IGHJ4*01 | 2430 | O12_IGKJ1*01 | 833 | 1438 |
| 362 | VH3-23_IGHD2-15*01>3_IGHJ4*01 | 2431 | O12_IGKJ1*01 | 833 | 1438 |
| 363 | VH3-23_IGHD2-21*01>2_IGHJ4*01 | 2432 | O12_IGKJ1*01 | 833 | 1438 |
| 364 | VH3-23_IGHD2-21*01>3_IGHJ4*01 | 2433 | O12_IGKJ1*01 | 833 | 1438 |
| 365 | VH3-23_IGHD3-3*01>1_IGHJ4*01 | 2434 | O12_IGKJ1*01 | 833 | 1438 |
| 366 | VH3-23_IGHD3-3*01>2_IGHJ4*01 | 2435 | O12_IGKJ1*01 | 833 | 1438 |
| 367 | VH3-23_IGHD3-3*01>3_IGHJ4*01 | 2436 | O12_IGKJ1*01 | 833 | 1438 |
| 368 | VH3-23_IGHD3-9*01>2_IGHJ4*01 | 2437 | O12_IGKJ1*01 | 833 | 1438 |
| 369 | VH3-23_IGHD3-10*01>2_IGHJ4*01 | 2438 | O12_IGKJ1*01 | 833 | 1438 |
| 370 | VH3-23_IGHD3-10*01>3_IGHJ4*01 | 2439 | O12_IGKJ1*01 | 833 | 1438 |
| 371 | VH3-23_IGHD3-16*01>2_IGHJ4*01 | 2440 | O12_IGKJ1*01 | 833 | 1438 |
| 372 | VH3-23_IGHD3-16*01>3_IGHJ4*01 | 2441 | O12_IGKJ1*01 | 833 | 1438 |
| 373 | VH3-23_IGHD3-22*01>2_IGHJ4*01 | 2442 | O12_IGKJ1*01 | 833 | 1438 |
| 374 | VH3-23_IGHD3-22*01>3_IGHJ4*01 | 2443 | O12_IGKJ1*01 | 833 | 1438 |
| 375 | VH3-23_IGHD4-4*01 (1) >2_IGHJ4*01 | 2444 | O12_IGKJ1*01 | 833 | 1438 |
| 376 | VH3-23_IGHD4-4*01 (1) >3_IGHJ4*01 | 2445 | O12_IGKJ1*01 | 833 | 1438 |
| 377 | VH3-23_IGHD4-11*01 (1) >2_IGHJ4*01 | 2446 | O12_IGKJ1*01 | 833 | 1438 |
| 378 | VH3-23_IGHD4-11*01 (1) >3_IGHJ4*01 | 2447 | O12_IGKJ1*01 | 833 | 1438 |
| 379 | VH3-23_IGHD4-17*01>2_IGHJ4*01 | 2448 | O12_IGKJ1*01 | 833 | 1438 |
| 380 | VH3-23_IGHD4-17*01>3_IGHJ4*01 | 2449 | O12_IGKJ1*01 | 833 | 1438 |
| 381 | VH3-23_IGHD4-23*01>2_IGHJ4*01 | 2450 | O12_IGKJ1*01 | 833 | 1438 |
| 382 | VH3-23_IGHD4-23*01>3_IGHJ4*01 | 2451 | O12_IGKJ1*01 | 833 | 1438 |
| 383 | VH3-23_IGHD5-5*01 (2) >1_IGHJ4*01 | 2452 | O12_IGKJ1*01 | 833 | 1438 |
| 384 | VH3-23_IGHD5-5*01 (2) >2_IGHJ4*01 | 2453 | O12_IGKJ1*01 | 833 | 1438 |
| 385 | VH3-23_IGHD5-5*01 (2) >3_IGHJ4*01 | 2454 | O12_IGKJ1*01 | 833 | 1438 |
| 386 | VH3-23_IGHD5-12*01>1_IGHJ4*01 | 2455 | O12_IGKJ1*01 | 833 | 1438 |
| 387 | VH3-23_IGHD5-12*01>3_IGHJ4*01 | 2456 | O12_IGKJ1*01 | 833 | 1438 |
| 388 | VH3-23_IGHD5-18*01 (2) >1_IGHJ4*01 | 2457 | O12_IGKJ1*01 | 833 | 1438 |
| 389 | VH3-23_IGHD5-18*01 (2) >2_IGHJ4*01 | 2458 | O12_IGKJ1*01 | 833 | 1438 |
| 390 | VH3-23_IGHD5-18*01 (2) >3_IGHJ4*01 | 2459 | O12_IGKJ1*01 | 833 | 1438 |
| 391 | VH3-23_IGHD5-24*01>1_IGHJ4*01 | 2460 | O12_IGKJ1*01 | 833 | 1438 |
| 392 | VH3-23_IGHD5-24*01>3_IGHJ4*01 | 2461 | O12_IGKJ1*01 | 833 | 1438 |
| 393 | VH3-23_IGHD6-6*01>1_IGHJ4*01 | 2462 | O12_IGKJ1*01 | 833 | 1438 |
| 394 | VH3-23_IGHD1-1*01>1'_IGHJ4*01 | 2472 | O12_IGKJ1*01 | 833 | 1438 |
| 395 | VH3-23_IGHD1-1*01>2'_IGHJ4*01 | 2473 | O12_IGKJ1*01 | 833 | 1438 |
| 396 | VH3-23_IGHD1-1*01>3'_IGHJ4*01 | 2474 | O12_IGKJ1*01 | 833 | 1438 |
| 397 | VH3-23_IGHD1-7*01>1'_IGHJ4*01 | 2475 | O12_IGKJ1*01 | 833 | 1438 |
| 398 | VH3-23_IGHD1-7*01>3'_IGHJ4*01 | 2476 | O12_IGKJ1*01 | 833 | 1438 |
| 399 | VH3-23_IGHD1-14*01>1'_IGHJ4*01 | 2477 | O12_IGKJ1*01 | 833 | 1438 |
| 400 | VH3-23_IGHD1-14*01>2'_IGHJ4*01 | 2478 | O12_IGKJ1*01 | 833 | 1438 |
| 401 | VH3-23_IGHD1-14*01>3'_IGHJ4*01 | 2479 | O12_IGKJ1*01 | 833 | 1438 |
| 402 | VH3-23_IGHD1-20*01>1'_IGHJ4*01 | 2480 | O12_IGKJ1*01 | 833 | 1438 |
| 403 | VH3-23_IGHD1-20*01>2'_IGHJ4*01 | 2481 | O12_IGKJ1*01 | 833 | 1438 |
| 404 | VH3-23_IGHD1-20*01>3'_IGHJ4*01 | 2482 | O12_IGKJ1*01 | 833 | 1438 |
| 405 | VH3-23_IGHD1-26*01>1'_IGHJ4*01 | 2483 | O12_IGKJ1*01 | 833 | 1438 |
| 406 | VH3-23_IGHD1-26*01>1'_IGHJ4*01_B | 2484 | O12_IGKJ1*01 | 833 | 1438 |
| 407 | VH3-23_IGHD2-2*01>1'_IGHJ4*01 | 2485 | O12_IGKJ1*01 | 833 | 1438 |
| 408 | VH3-23_IGHD2-2*01>3'_IGHJ4*01 | 2486 | O12_IGKJ1*01 | 833 | 1438 |
| 409 | VH3-23_IGHD2-8*01>1'_IGHJ4*01 | 2487 | O12_IGKJ1*01 | 833 | 1438 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 410 | VH3-23_IGHD2-15*01>1'_IGHJ4*01 | 2488 | O12_IGKJ1*01 | 833 | 1438 |
| 411 | VH3-23_IGHD2-15*01>3'_IGHJ4*01 | 2489 | O12_IGKJ1*01 | 833 | 1438 |
| 412 | VH3-23_IGHD2-21*01>1'_IGHJ4*01 | 2490 | O12_IGKJ1*01 | 833 | 1438 |
| 413 | VH3-23_IGHD2-21*01>3'_IGHJ4*01 | 2491 | O12_IGKJ1*01 | 833 | 1438 |
| 414 | VH3-23_IGHD3-3*01>1'_IGHJ4*01 | 2492 | O12_IGKJ1*01 | 833 | 1438 |
| 415 | VH3-23_IGHD3-3*01>3'_IGHJ4*01 | 2493 | O12_IGKJ1*01 | 833 | 1438 |
| 416 | VH3-23_IGHD3-9*01>1'_IGHJ4*01 | 2494 | O12_IGKJ1*01 | 833 | 1438 |
| 417 | VH3-23_IGHD3-9*01>3'_IGHJ4*01 | 2495 | O12_IGKJ1*01 | 833 | 1438 |
| 418 | VH3-23_IGHD3-10*01>1'_IGHJ4*01 | 2496 | O12_IGKJ1*01 | 833 | 1438 |
| 419 | VH3-23_IGHD3-10*01>3'_IGHJ4*01 | 2497 | O12_IGKJ1*01 | 833 | 1438 |
| 420 | VH3-23_IGHD3-16*01>1'_IGHJ4*01 | 2498 | O12_IGKJ1*01 | 833 | 1438 |
| 421 | VH3-23_IGHD3-16*01>3'_IGHJ4*01 | 2499 | O12_IGKJ1*01 | 833 | 1438 |
| 422 | VH3-23_IGHD3-22*01>1'_IGHJ4*01 | 2500 | O12_IGKJ1*01 | 833 | 1438 |
| 423 | VH3-23_IGHD4-4*01 (1) >1'_IGHJ4*01 | 2501 | O12_IGKJ1*01 | 833 | 1438 |
| 424 | VH3-23_IGHD4-4*01 (1) >3'_IGHJ4*01 | 2502 | O12_IGKJ1*01 | 833 | 1438 |
| 425 | VH3-23_IGHD4-11*01 (1) >1'_IGHJ4*01 | 2503 | O12_IGKJ1*01 | 833 | 1438 |
| 426 | VH3-23_IGHD4-11*01 (1) >3'_IGHJ4*01 | 2504 | O12_IGKJ1*01 | 833 | 1438 |
| 427 | VH3-23_IGHD4-17*01>1'_IGHJ4*01 | 2505 | O12_IGKJ1*01 | 833 | 1438 |
| 428 | VH3-23_IGHD4-17*01>3'_IGHJ4*01 | 2506 | O12_IGKJ1*01 | 833 | 1438 |
| 429 | VH3-23_IGHD4-23*01>1'_IGHJ4*01 | 2507 | O12_IGKJ1*01 | 833 | 1438 |
| 430 | VH3-23_IGHD4-23*01>3'_IGHJ4*01 | 2508 | O12_IGKJ1*01 | 833 | 1438 |
| 431 | VH3-23_IGHD5-5*01 (2) >1'_IGHJ4*01 | 2509 | O12_IGKJ1*01 | 833 | 1438 |
| 432 | VH3-23_IGHD5-5*01 (2) >3'_IGHJ4*01 | 2510 | O12_IGKJ1*01 | 833 | 1438 |
| 433 | VH3-23_IGHD5-12*01>1'_IGHJ4*01 | 2511 | O12_IGKJ1*01 | 833 | 1438 |
| 434 | VH3-23_IGHD5-12*01>3'_IGHJ4*01 | 2512 | O12_IGKJ1*01 | 833 | 1438 |
| 435 | VH3-23_IGHD5-18*01 (2) >1'_IGHJ4*01 | 2513 | O12_IGKJ1*01 | 833 | 1438 |
| 436 | VH3-23_IGHD5-18*01 (2) >3'_IGHJ4*01 | 2514 | O12_IGKJ1*01 | 833 | 1438 |
| 437 | VH3-23_IGHD5-24*01>1'_IGHJ4*01 | 2515 | O12_IGKJ1*01 | 833 | 1438 |
| 438 | VH3-23_IGHD5-24*01>3'_IGHJ4*01 | 2516 | O12_IGKJ1*01 | 833 | 1438 |
| 439 | VH3-23_IGHD6-6*01>1'_IGHJ4*01 | 2517 | O12_IGKJ1*01 | 833 | 1438 |
| 440 | VH3-23_IGHD6-6*01>2'_IGHJ4*01 | 2518 | O12_IGKJ1*01 | 833 | 1438 |
| 441 | VH3-23_IGHD6-6*01>3'_IGHJ4*01 | 2519 | O12_IGKJ1*01 | 833 | 1438 |
| 442 | VH3-23_IGHD6-6*01>2_IGHJ4*01 | 2463 | O12_IGKJ1*01 | 833 | 1438 |
| 443 | VH3-23_IGHD6-13*01>1_IGHJ4*01 | 2464 | O12_IGKJ1*01 | 833 | 1438 |
| 444 | VH3-23_IGHD6-13*01>2_IGHJ4*01 | 2465 | O12_IGKJ1*01 | 833 | 1438 |
| 445 | VH3-23_IGHD6-19*01>1_IGHJ4*01 | 2466 | O12_IGKJ1*01 | 833 | 1438 |
| 446 | VH3-23_IGHD6-19*01>2_IGHJ4*01 | 2467 | O12_IGKJ1*01 | 833 | 1438 |
| 447 | VH3-23_IGHD6-25*01>1_IGHJ4*01 | 2468 | O12_IGKJ1*01 | 833 | 1438 |
| 448 | VH3-23_IGHD6-25*01>2_IGHJ4*01 | 2469 | O12_IGKJ1*01 | 833 | 1438 |
| 449 | VH3-23_IGHD7-27*01>1_IGHJ4*01 | 2470 | O12_IGKJ1*01 | 833 | 1438 |
| 450 | VH3-23_IGHD7-27*01>3_IGHJ4*01 | 2471 | O12_IGKJ1*01 | 833 | 1438 |
| 451 | VH3-23_IGHD6-13*01>1'_IGHJ4*01 | 2520 | O12_IGKJ1*01 | 833 | 1438 |
| 452 | VH3-23_IGHD6-13*01>2'_IGHJ4*01 | 2521 | O12_IGKJ1*01 | 833 | 1438 |
| 453 | VH3-23_IGHD6-13*01>2_IGHJ4*01_B | 2522 | O12_IGKJ1*01 | 833 | 1438 |
| 454 | VH3-23_IGHD6-19*01>1'_IGHJ4*01 | 2523 | O12_IGKJ1*01 | 833 | 1438 |
| 455 | VH3-23_IGHD6-19*01>2'_IGHJ4*01 | 2524 | O12_IGKJ1*01 | 833 | 1438 |
| 456 | VH3-23_IGHD6-19*01>2_IGHJ4*01_B | 2525 | O12_IGKJ1*01 | 833 | 1438 |
| 457 | VH3-23_IGHD6-25*01>1'_IGHJ4*01 | 2526 | O12_IGKJ1*01 | 833 | 1438 |
| 458 | VH3-23_IGHD6-25*01>3'_IGHJ4*01 | 2527 | O12_IGKJ1*01 | 833 | 1438 |
| 459 | VH3-23_IGHD7-27*01>1'_IGHJ4*01 | 2528 | O12_IGKJ1*01 | 833 | 1438 |
| 460 | VH3-23_IGHD7-27*01>2'_IGHJ4*01 | 2529 | O12_IGKJ1*01 | 833 | 1438 |
| 461 | VH3-23_IGHD1-1*01>1_IGHJ5*01 | 2530 | O12_IGKJ1*01 | 833 | 1438 |
| 462 | VH3-23_IGHD1-1*01>2_IGHJ5*01 | 2531 | O12_IGKJ1*01 | 833 | 1438 |
| 463 | VH3-23_IGHD1-1*01>3_IGHJ5*01 | 2532 | O12_IGKJ1*01 | 833 | 1438 |
| 464 | VH3-23_IGHD1-7*01>1_IGHJ5*01 | 2533 | O12_IGKJ1*01 | 833 | 1438 |
| 465 | VH3-23_IGHD1-7*01>3_IGHJ5*01 | 2534 | O12_IGKJ1*01 | 833 | 1438 |
| 466 | VH3-23_IGHD1-14*01>1_IGHJ5*01 | 2535 | O12_IGKJ1*01 | 833 | 1438 |
| 467 | VH3-23_IGHD1-14*01>3_IGHJ5*01 | 2536 | O12_IGKJ1*01 | 833 | 1438 |
| 468 | VH3-23_IGHD1-20*01>1_IGHJ5*01 | 2537 | O12_IGKJ1*01 | 833 | 1438 |
| 469 | VH3-23_IGHD1-20*01>3_IGHJ5*01 | 2538 | O12_IGKJ1*01 | 833 | 1438 |
| 470 | VH3-23_IGHD1-26*01>1_IGHJ5*01 | 2539 | O12_IGKJ1*01 | 833 | 1438 |
| 471 | VH3-23_IGHD1-26*01>3_IGHJ5*01 | 2540 | O12_IGKJ1*01 | 833 | 1438 |
| 472 | VH3-23_IGHD2-2*01>2_IGHJ5*01 | 2541 | O12_IGKJ1*01 | 833 | 1438 |
| 473 | VH3-23_IGHD2-2*01>3_IGHJ5*01 | 2542 | O12_IGKJ1*01 | 833 | 1438 |
| 474 | VH3-23_IGHD2-8*01>2_IGHJ5*01 | 2543 | O12_IGKJ1*01 | 833 | 1438 |
| 475 | VH3-23_IGHD2-8*01>3_IGHJ5*01 | 2544 | O12_IGKJ1*01 | 833 | 1438 |
| 476 | VH3-23_IGHD2-15*01>2_IGHJ5*01 | 2545 | O12_IGKJ1*01 | 833 | 1438 |
| 477 | VH3-23_IGHD2-15*01>3_IGHJ5*01 | 2546 | O12_IGKJ1*01 | 833 | 1438 |
| 478 | VH3-23_IGHD2-21*01>2_IGHJ5*01 | 2547 | O12_IGKJ1*01 | 833 | 1438 |
| 479 | VH3-23_IGHD2-21*01>3_IGHJ5*01 | 2548 | O12_IGKJ1*01 | 833 | 1438 |
| 480 | VH3-23_IGHD3-3*01>1_IGHJ5*01 | 2549 | O12_IGKJ1*01 | 833 | 1438 |
| 481 | VH3-23_IGHD3-3*01>2_IGHJ5*01 | 2550 | O12_IGKJ1*01 | 833 | 1438 |
| 482 | VH3-23_IGHD3-3*01>3_IGHJ5*01 | 2551 | O12_IGKJ1*01 | 833 | 1438 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 483 | VH3-23_IGHD3-9*01>2_IGHJ5*01 | 2552 | O12_IGKJ1*01 | 833 | 1438 |
| 484 | VH3-23_IGHD3-10*01>2_IGHJ5*01 | 2553 | O12_IGKJ1*01 | 833 | 1438 |
| 485 | VH3-23_IGHD3-10*01>3_IGHJ5*01 | 2554 | O12_IGKJ1*01 | 833 | 1438 |
| 486 | VH3-23_IGHD3-16*01>2_IGHJ5*01 | 2555 | O12_IGKJ1*01 | 833 | 1438 |
| 487 | VH3-23_IGHD3-16*01>3_IGHJ5*01 | 2556 | O12_IGKJ1*01 | 833 | 1438 |
| 488 | VH3-23_IGHD3-22*01>2_IGHJ5*01 | 2557 | O12_IGKJ1*01 | 833 | 1438 |
| 489 | VH3-23_IGHD3-22*01>3_IGHJ5*01 | 2558 | O12_IGKJ1*01 | 833 | 1438 |
| 490 | VH3-23_IGHD4-4*01 (1) >2_IGHJ5*01 | 2559 | O12_IGKJ1*01 | 833 | 1438 |
| 491 | VH3-23_IGHD4-4*01 (1) >3_IGHJ5*01 | 2560 | O12_IGKJ1*01 | 833 | 1438 |
| 492 | VH3-23_IGHD4-11*01 (1) >2_IGHJ5*01 | 2561 | O12_IGKJ1*01 | 833 | 1438 |
| 493 | VH3-23_IGHD4-11*01 (1) >3_IGHJ5*01 | 2562 | O12_IGKJ1*01 | 833 | 1438 |
| 494 | VH3-23_IGHD4-17*01>2_IGHJ5*01 | 2563 | O12_IGKJ1*01 | 833 | 1438 |
| 495 | VH3-23_IGHD4-17*01>3_IGHJ5*01 | 2564 | O12_IGKJ1*01 | 833 | 1438 |
| 496 | VH3-23_IGHD4-23*01>2_IGHJ5*01 | 2565 | O12_IGKJ1*01 | 833 | 1438 |
| 497 | VH3-23_IGHD4-23*01>3_IGHJ5*01 | 2566 | O12_IGKJ1*01 | 833 | 1438 |
| 498 | VH3-23_IGHD5-5*01 (2) >1_IGHJ5*01 | 2567 | O12_IGKJ1*01 | 833 | 1438 |
| 499 | VH3-23_IGHD5-5*01 (2) >2_IGHJ5*01 | 2568 | O12_IGKJ1*01 | 833 | 1438 |
| 500 | VH3-23_IGHD5-5*01 (2) >3_IGHJ5*01 | 2569 | O12_IGKJ1*01 | 833 | 1438 |
| 501 | VH3-23_IGHD5-12*01>1_IGHJ5*01 | 2570 | O12_IGKJ1*01 | 833 | 1438 |
| 502 | VH3-23_IGHD5-12*01>3_IGHJ5*01 | 2571 | O12_IGKJ1*01 | 833 | 1438 |
| 503 | VH3-23_IGHD5-18*01 (2) >1_IGHJ5*01 | 2572 | O12_IGKJ1*01 | 833 | 1438 |
| 504 | VH3-23_IGHD5-18*01 (2) >2_IGHJ5*01 | 2573 | O12_IGKJ1*01 | 833 | 1438 |
| 505 | VH3-23_IGHD5-18*01 (2) >3_IGHJ5*01 | 2574 | O12_IGKJ1*01 | 833 | 1438 |
| 506 | VH3-23_IGHD5-24*01>1_IGHJ5*01 | 2575 | O12_IGKJ1*01 | 833 | 1438 |
| 507 | VH3-23_IGHD5-24*01>3_IGHJ5*01 | 2576 | O12_IGKJ1*01 | 833 | 1438 |
| 508 | VH3-23_IGHD6-6*01>1_IGHJ5*01 | 2577 | O12_IGKJ1*01 | 833 | 1438 |
| 509 | VH3-23_IGHD1-1*01>1'_IGHJ5*01 | 2587 | O12_IGKJ1*01 | 833 | 1438 |
| 510 | VH3-23_IGHD1-1*01>2'_IGHJ5*01 | 2588 | O12_IGKJ1*01 | 833 | 1438 |
| 511 | VH3-23_IGHD1-1*01>3'_IGHJ5*01 | 2589 | O12_IGKJ1*01 | 833 | 1438 |
| 512 | VH3-23_IGHD1-7*01>1'_IGHJ5*01 | 2590 | O12_IGKJ1*01 | 833 | 1438 |
| 513 | VH3-23_IGHD1-7*01>3'_IGHJ5*01 | 2591 | O12_IGKJ1*01 | 833 | 1438 |
| 514 | VH3-23_IGHD1-14*01>1'_IGHJ5*01 | 2592 | O12_IGKJ1*01 | 833 | 1438 |
| 515 | VH3-23_IGHD1-14*01>2'_IGHJ5*01 | 2593 | O12_IGKJ1*01 | 833 | 1438 |
| 516 | VH3-23_IGHD1-14*01>3'_IGHJ5*01 | 2594 | O12_IGKJ1*01 | 833 | 1438 |
| 517 | VH3-23_IGHD1-20*01>1'_IGHJ5*01 | 2595 | O12_IGKJ1*01 | 833 | 1438 |
| 518 | VH3-23_IGHD1-20*01>2'_IGHJ5*01 | 2596 | O12_IGKJ1*01 | 833 | 1438 |
| 519 | VH3-23_IGHD1-20*01>3'_IGHJ5*01 | 2597 | O12_IGKJ1*01 | 833 | 1438 |
| 520 | VH3-23_IGHD1-26*01>1'_IGHJ5*01 | 2598 | O12_IGKJ1*01 | 833 | 1438 |
| 521 | VH3-23_IGHD1-26*01>3'_IGHJ5*01 | 2599 | O12_IGKJ1*01 | 833 | 1438 |
| 522 | VH3-23_IGHD2-2*01>1'_IGHJ5*01 | 2600 | O12_IGKJ1*01 | 833 | 1438 |
| 523 | VH3-23_IGHD2-2*01>3'_IGHJ5*01 | 2601 | O12_IGKJ1*01 | 833 | 1438 |
| 524 | VH3-23_IGHD2-8*01>1'_IGHJ5*01 | 2602 | O12_IGKJ1*01 | 833 | 1438 |
| 525 | VH3-23_IGHD2-15*01>1'_IGHJ5*01 | 2603 | O12_IGKJ1*01 | 833 | 1438 |
| 526 | VH3-23_IGHD2-15*01>3'_IGHJ5*01 | 2604 | O12_IGKJ1*01 | 833 | 1438 |
| 527 | VH3-23_IGHD2-21*01>1'_IGHJ5*01 | 2605 | O12_IGKJ1*01 | 833 | 1438 |
| 528 | VH3-23_IGHD2-21*01>3'_IGHJ5*01 | 2606 | O12_IGKJ1*01 | 833 | 1438 |
| 529 | VH3-23_IGHD3-3*01>1'_IGHJ5*01 | 2607 | O12_IGKJ1*01 | 833 | 1438 |
| 530 | VH3-23_IGHD3-3*01>3'_IGHJ5*01 | 2608 | O12_IGKJ1*01 | 833 | 1438 |
| 531 | VH3-23_IGHD3-9*01>1'_IGHJ5*01 | 2609 | O12_IGKJ1*01 | 833 | 1438 |
| 532 | VH3-23_IGHD3-9*01>3'_IGHJ5*01 | 2610 | O12_IGKJ1*01 | 833 | 1438 |
| 533 | VH3-23_IGHD3-10*01>1'_IGHJ5*01 | 2611 | O12_IGKJ1*01 | 833 | 1438 |
| 534 | VH3-23_IGHD3-10*01>3'_IGHJ5*01 | 2612 | O12_IGKJ1*01 | 833 | 1438 |
| 535 | VH3-23_IGHD3-16*01>1'_IGHJ5*01 | 2613 | O12_IGKJ1*01 | 833 | 1438 |
| 536 | VH3-23_IGHD3-16*01>3'_IGHJ5*01 | 2614 | O12_IGKJ1*01 | 833 | 1438 |
| 537 | VH3-23_IGHD3-22*01>1'_IGHJ5*01 | 2615 | O12_IGKJ1*01 | 833 | 1438 |
| 538 | VH3-23_IGHD4-4*01 (1) >1'_IGHJ5*01 | 2616 | O12_IGKJ1*01 | 833 | 1438 |
| 539 | VH3-23_IGHD4-4*01 (1) >3'_IGHJ5*01 | 2617 | O12_IGKJ1*01 | 833 | 1438 |
| 540 | VH3-23_IGHD4-11*01 (1) >1'_IGHJ5*01 | 2618 | O12_IGKJ1*01 | 833 | 1438 |
| 541 | VH3-23_IGHD4-11*01 (1) >3'_IGHJ5*01 | 2619 | O12_IGKJ1*01 | 833 | 1438 |
| 542 | VH3-23_IGHD4-17*01>1'_IGHJ5*01 | 2620 | O12_IGKJ1*01 | 833 | 1438 |
| 543 | VH3-23_IGHD4-17*01>3'_IGHJ5*01 | 2621 | O12_IGKJ1*01 | 833 | 1438 |
| 544 | VH3-23_IGHD4-23*01>1'_IGHJ5*01 | 2622 | O12_IGKJ1*01 | 833 | 1438 |
| 545 | VH3-23_IGHD4-23*01>3'_IGHJ5*01 | 2623 | O12_IGKJ1*01 | 833 | 1438 |
| 546 | VH3-23_IGHD5-5*01 (2) >1'_IGHJ5*01 | 2624 | O12_IGKJ1*01 | 833 | 1438 |
| 547 | VH3-23_IGHD5-5*01 (2) >3'_IGHJ5*01 | 2625 | O12_IGKJ1*01 | 833 | 1438 |
| 548 | VH3-23_IGHD5-12*01>1'_IGHJ5*01 | 2626 | O12_IGKJ1*01 | 833 | 1438 |
| 549 | VH3-23_IGHD5-12*01>3'_IGHJ5*01 | 2627 | O12_IGKJ1*01 | 833 | 1438 |
| 550 | VH3-23_IGHD5-18*01 (2) >1'_IGHJ5*01 | 2628 | O12_IGKJ1*01 | 833 | 1438 |
| 551 | VH3-23_IGHD5-18*01 (2) >3'_IGHJ5*01 | 2629 | O12_IGKJ1*01 | 833 | 1438 |
| 552 | VH3-23_IGHD5-24*01>1'_IGHJ5*01 | 2630 | O12_IGKJ1*01 | 833 | 1438 |
| 553 | VH3-23_IGHD5-24*01>3'_IGHJ5*01 | 2631 | O12_IGKJ1*01 | 833 | 1438 |
| 554 | VH3-23_IGHD6-6*01>1'_IGHJ5*01 | 2632 | O12_IGKJ1*01 | 833 | 1438 |
| 555 | VH3-23_IGHD6-6*01>2'_IGHJ5*01 | 2633 | O12_IGKJ1*01 | 833 | 1438 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 556 | VH3-23_IGHD6-6*01>3'_IGHJ5*01 | 2634 | O12_IGKJ1*01 | 833 | 1438 |
| 557 | VH3-23_IGHD6-6*01>2_IGHJ5*01 | 2578 | O12_IGKJ1*01 | 833 | 1438 |
| 558 | VH3-23_IGHD6-13*01>1_IGHJ5*01 | 2579 | O12_IGKJ1*01 | 833 | 1438 |
| 559 | VH3-23_IGHD6-13*01>2_IGHJ5*01 | 2580 | O12_IGKJ1*01 | 833 | 1438 |
| 560 | VH3-23_IGHD6-19*01>1_IGHJ5*01 | 2581 | O12_IGKJ1*01 | 833 | 1438 |
| 561 | VH3-23_IGHD6-19*01>2_IGHJ5*01 | 2582 | O12_IGKJ1*01 | 833 | 1438 |
| 562 | VH3-23_IGHD6-25*01>1_IGHJ5*01 | 2583 | O12_IGKJ1*01 | 833 | 1438 |
| 563 | VH3-23_IGHD6-25*01>2_IGHJ5*01 | 2584 | O12_IGKJ1*01 | 833 | 1438 |
| 564 | VH3-23_IGHD7-27*01>1_IGHJ5*01 | 2585 | O12_IGKJ1*01 | 833 | 1438 |
| 565 | VH3-23_IGHD7-27*01>3_IGHJ5*01 | 2586 | O12_IGKJ1*01 | 833 | 1438 |
| 566 | VH3-23_IGHD6-13*01>1'_IGHJ5*01 | 2635 | O12_IGKJ1*01 | 833 | 1438 |
| 567 | VH3-23_IGHD6-13*01>2'_IGHJ5*01 | 2636 | O12_IGKJ1*01 | 833 | 1438 |
| 568 | VH3-23_IGHD6-13*01>3'_IGHJ5*01 | 2637 | O12_IGKJ1*01 | 833 | 1438 |
| 569 | VH3-23_IGHD6-19*01>1'_IGHJ5*01 | 2638 | O12_IGKJ1*01 | 833 | 1438 |
| 570 | VH3-23_IGHD6-19*01>2'_IGHJ5*01 | 2639 | O12_IGKJ1*01 | 833 | 1438 |
| 571 | VH3-23_IGHD6-19*01>2'_IGHJ5*01_B | 2640 | O12_IGKJ1*01 | 833 | 1438 |
| 572 | VH3-23_IGHD6-25*01>1'_IGHJ5*01 | 2641 | O12_IGKJ1*01 | 833 | 1438 |
| 573 | VH3-23_IGHD6-25*01>3'_IGHJ5*01 | 2642 | O12_IGKJ1*01 | 833 | 1438 |
| 574 | VH3-23_IGHD7-27*01>1'_IGHJ5*01 | 2643 | O12_IGKJ1*01 | 833 | 1438 |
| 575 | VH3-23_IGHD7-27*01>2'_IGHJ5*01 | 2644 | O12_IGKJ1*01 | 833 | 1438 |
| 576 | VH3-23_IGHD1-1*01>1_IGHJ6*01 | 2645 | O12_IGKJ1*01 | 833 | 1438 |
| 577 | VH3-23_IGHD1-1*01>2_IGHJ6*01 | 2646 | O12_IGKJ1*01 | 833 | 1438 |
| 578 | VH3-23_IGHD1-1*01>3_IGHJ6*01 | 2647 | O12_IGKJ1*01 | 833 | 1438 |
| 579 | VH3-23_IGHD1-7*01>1_IGHJ6*01 | 2648 | O12_IGKJ1*01 | 833 | 1438 |
| 580 | VH3-23_IGHD1-7*01>3_IGHJ6*01 | 2649 | O12_IGKJ1*01 | 833 | 1438 |
| 581 | VH3-23_IGHD1-14*01>1_IGHJ6*01 | 2650 | O12_IGKJ1*01 | 833 | 1438 |
| 582 | VH3-23_IGHD1-14*01>3_IGHJ6*01 | 2651 | O12_IGKJ1*01 | 833 | 1438 |
| 583 | VH3-23_IGHD1-20*01>1_IGHJ6*01 | 2652 | O12_IGKJ1*01 | 833 | 1438 |
| 584 | VH3-23_IGHD1-20*01>3_IGHJ6*01 | 2653 | O12_IGKJ1*01 | 833 | 1438 |
| 585 | VH3-23_IGHD1-26*01>1_IGHJ6*01 | 2654 | O12_IGKJ1*01 | 833 | 1438 |
| 586 | VH3-23_IGHD1-26*01>3_IGHJ6*01 | 2655 | O12_IGKJ1*01 | 833 | 1438 |
| 587 | VH3-23_IGHD2-2*01>2_IGHJ6*01 | 2656 | O12_IGKJ1*01 | 833 | 1438 |
| 588 | VH3-23_IGHD2-2*01>3_IGHJ6*01 | 2657 | O12_IGKJ1*01 | 833 | 1438 |
| 589 | VH3-23_IGHD2-8*01>2_IGHJ6*01 | 2658 | O12_IGKJ1*01 | 833 | 1438 |
| 590 | VH3-23_IGHD2-8*01>3_IGHJ6*01 | 2659 | O12_IGKJ1*01 | 833 | 1438 |
| 591 | VH3-23_IGHD2-15*01>2_IGHJ6*01 | 2660 | O12_IGKJ1*01 | 833 | 1438 |
| 592 | VH3-23_IGHD2-15*01>3_IGHJ6*01 | 2661 | O12_IGKJ1*01 | 833 | 1438 |
| 593 | VH3-23_IGHD2-21*01>2_IGHJ6*01 | 2662 | O12_IGKJ1*01 | 833 | 1438 |
| 594 | VH3-23_IGHD2-21*01>3_IGHJ6*01 | 2663 | O12_IGKJ1*01 | 833 | 1438 |
| 595 | VH3-23_IGHD3-3*01>1_IGHJ6*01 | 2664 | O12_IGKJ1*01 | 833 | 1438 |
| 596 | VH3-23_IGHD3-3*01>2_IGHJ6*01 | 2665 | O12_IGKJ1*01 | 833 | 1438 |
| 597 | VH3-23_IGHD3-3*01>3_IGHJ6*01 | 2666 | O12_IGKJ1*01 | 833 | 1438 |
| 598 | VH3-23_IGHD3-9*01>2_IGHJ6*01 | 2667 | O12_IGKJ1*01 | 833 | 1438 |
| 599 | VH3-23_IGHD3-10*01>2_IGHJ6*01 | 2668 | O12_IGKJ1*01 | 833 | 1438 |
| 600 | VH3-23_IGHD3-10*01>3_IGHJ6*01 | 2669 | O12_IGKJ1*01 | 833 | 1438 |
| 601 | VH3-23_IGHD3-16*01>2_IGHJ6*01 | 2670 | O12_IGKJ1*01 | 833 | 1438 |
| 602 | VH3-23_IGHD3-16*01>3_IGHJ6*01 | 2671 | O12_IGKJ1*01 | 833 | 1438 |
| 603 | VH3-23_IGHD3-22*01>2_IGHJ6*01 | 2672 | O12_IGKJ1*01 | 833 | 1438 |
| 604 | VH3-23_IGHD3-22*01>3_IGHJ6*01 | 2673 | O12_IGKJ1*01 | 833 | 1438 |
| 605 | VH3-23_IGHD4-4*01 (1) >2_IGHJ6*01 | 2674 | O12_IGKJ1*01 | 833 | 1438 |
| 606 | VH3-23_IGHD4-4*01 (1) >3_IGHJ6*01 | 2675 | O12_IGKJ1*01 | 833 | 1438 |
| 607 | VH3-23_IGHD4-11*01 (1) >2_IGHJ6*01 | 2676 | O12_IGKJ1*01 | 833 | 1438 |
| 608 | VH3-23_IGHD4-11*01 (1) >3_IGHJ6*01 | 2677 | O12_IGKJ1*01 | 833 | 1438 |
| 609 | VH3-23_IGHD4-17*01>2_IGHJ6*01 | 2678 | O12_IGKJ1*01 | 833 | 1438 |
| 610 | VH3-23_IGHD4-17*01>3_IGHJ6*01 | 2679 | O12_IGKJ1*01 | 833 | 1438 |
| 611 | VH3-23_IGHD4-23*01>2_IGHJ6*01 | 2680 | O12_IGKJ1*01 | 833 | 1438 |
| 612 | VH3-23_IGHD4-23*01>3_IGHJ6*01 | 2681 | O12_IGKJ1*01 | 833 | 1438 |
| 613 | VH3-23_IGHD5-5*01 (2) >1_IGHJ6*01 | 2682 | O12_IGKJ1*01 | 833 | 1438 |
| 614 | VH3-23_IGHD5-5*01 (2) >2_IGHJ6*01 | 2683 | O12_IGKJ1*01 | 833 | 1438 |
| 615 | VH3-23_IGHD5-5*01 (2) >3_IGHJ6*01 | 2684 | O12_IGKJ1*01 | 833 | 1438 |
| 616 | VH3-23_IGHD5-12*01>1_IGHJ6*01 | 2685 | O12_IGKJ1*01 | 833 | 1438 |
| 617 | VH3-23_IGHD5-12*01>3_IGHJ6*01 | 2686 | O12_IGKJ1*01 | 833 | 1438 |
| 618 | VH3-23_IGHD5-18*01 (2) >1_IGHJ6*01 | 2687 | O12_IGKJ1*01 | 833 | 1438 |
| 619 | VH3-23_IGHD5-18*01 (2) >2_IGHJ6*01 | 2688 | O12_IGKJ1*01 | 833 | 1438 |
| 620 | VH3-23_IGHD5-18*01 (2) >3_IGHJ6*01 | 2689 | O12_IGKJ1*01 | 833 | 1438 |
| 621 | VH3-23_IGHD5-24*01>1_IGHJ6*01 | 2690 | O12_IGKJ1*01 | 833 | 1438 |
| 622 | VH3-23_IGHD5-24*01>3_IGHJ6*01 | 2691 | O12_IGKJ1*01 | 833 | 1438 |
| 623 | VH3-23_IGHD6-6*01>1_IGHJ6*01 | 2692 | O12_IGKJ1*01 | 833 | 1438 |
| 624 | VH3-23_IGHD6-6*01>2_IGHJ6*01 | 2693 | O12_IGKJ1*01 | 833 | 1438 |
| 625 | VH3-23_IGHD5-12*01>3'_IGHJ6*01 | 2742 | O12_IGKJ1*01 | 833 | 1438 |
| 626 | VH3-23_IGHD5-18*01(2)>1'_IGHJ6*01 | 2743 | O12_IGKJ1*01 | 833 | 1438 |
| 627 | VH3-23_IGHD5-18*01(2)>3'_IGHJ6*01 | 2744 | O12_IGKJ1*01 | 833 | 1438 |
| 628 | VH3-23_IGHD5-24*01>1'_IGHJ6*01 | 2745 | O12_IGKJ1*01 | 833 | 1438 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 629 | VH3-23_IGHD5-24*01>3'_IGHJ6*01 | 2746 | O12_IGKJ1*01 | 833 | 1438 |
| 630 | VH3-23_IGHD6-6*01>1'_IGHJ6*01 | 2747 | O12_IGKJ1*01 | 833 | 1438 |
| 631 | VH3-23_IGHD6-6*01>2'_IGHJ6*01 | 2748 | O12_IGKJ1*01 | 833 | 1438 |
| 632 | VH3-23_IGHD6-6*01>3'_IGHJ6*01 | 2749 | O12_IGKJ1*01 | 833 | 1438 |
| 633 | VH3-23_IGHD1-1*01>1'_IGHJ6*01 | 2702 | O12_IGKJ1*01 | 833 | 1438 |
| 634 | VH3-23_IGHD1-1*01>2'_IGHJ6*01 | 2703 | O12_IGKJ1*01 | 833 | 1438 |
| 635 | VH3-23_IGHD1-1*01>3'_IGHJ6*01 | 2704 | O12_IGKJ1*01 | 833 | 1438 |
| 636 | VH3-23_IGHD1-7*01>1'_IGHJ6*01 | 2705 | O12_IGKJ1*01 | 833 | 1438 |
| 637 | VH3-23_IGHD1-7*01>3'_IGHJ6*01 | 2706 | O12_IGKJ1*01 | 833 | 1438 |
| 638 | VH3-23_IGHD1-14*01>1'_IGHJ6*01 | 2707 | O12_IGKJ1*01 | 833 | 1438 |
| 639 | VH3-23_IGHD1-14*01>2'_IGHJ6*01 | 2708 | O12_IGKJ1*01 | 833 | 1438 |
| 640 | VH3-23_IGHD1-14*01>3'_IGHJ6*01 | 2709 | O12_IGKJ1*01 | 833 | 1438 |
| 641 | VH3-23_IGHD1-20*01>1'_IGHJ6*01 | 2710 | O12_IGKJ1*01 | 833 | 1438 |
| 642 | VH3-23_IGHD1-20*01>2'_IGHJ6*01 | 2711 | O12_IGKJ1*01 | 833 | 1438 |
| 643 | VH3-23_IGHD1-20*01>3'_IGHJ6*01 | 2712 | O12_IGKJ1*01 | 833 | 1438 |
| 644 | VH3-23_IGHD1-26*01>1'_IGHJ6*01 | 2713 | O12_IGKJ1*01 | 833 | 1438 |
| 645 | VH3-23_IGHD1-26*01>1_IGHJ6*01_B | 2714 | O12_IGKJ1*01 | 833 | 1438 |
| 646 | VH3-23_IGHD2-2*01>2_IGHJ6*01_B | 2715 | O12_IGKJ1*01 | 833 | 1438 |
| 647 | VH3-23_IGHD2-2*01>3'_IGHJ6*01 | 2716 | O12_IGKJ1*01 | 833 | 1438 |
| 648 | VH3-23_IGHD2-8*01>1'_IGHJ6*01 | 2717 | O12_IGKJ1*01 | 833 | 1438 |
| 649 | VH3-23_IGHD2-15*01>1'_IGHJ6*01 | 2718 | O12_IGKJ1*01 | 833 | 1438 |
| 650 | VH3-23_IGHD2-15*01>3'_IGHJ6*01 | 2719 | O12_IGKJ1*01 | 833 | 1438 |
| 651 | VH3-23_IGHD2-21*01>1'_IGHJ6*01 | 2720 | O12_IGKJ1*01 | 833 | 1438 |
| 652 | VH3-23_IGHD2-21*01>3'_IGHJ6*01 | 2721 | O12_IGKJ1*01 | 833 | 1438 |
| 653 | VH3-23_IGHD3-3*01>1'_IGHJ6*01 | 2722 | O12_IGKJ1*01 | 833 | 1438 |
| 654 | VH3-23_IGHD3-3*01>3'_IGHJ6*01 | 2723 | O12_IGKJ1*01 | 833 | 1438 |
| 655 | VH3-23_IGHD3-9*01>1'_IGHJ6*01 | 2724 | O12_IGKJ1*01 | 833 | 1438 |
| 656 | VH3-23_IGHD3-9*01>3'_IGHJ6*01 | 2725 | O12_IGKJ1*01 | 833 | 1438 |
| 657 | VH3-23_IGHD3-10*01>1'_IGHJ6*01 | 2726 | O12_IGKJ1*01 | 833 | 1438 |
| 658 | VH3-23_IGHD3-10*01>3'_IGHJ6*01 | 2727 | O12_IGKJ1*01 | 833 | 1438 |
| 659 | VH3-23_IGHD3-16*01>1'_IGHJ6*01 | 2728 | O12_IGKJ1*01 | 833 | 1438 |
| 660 | VH3-23_IGHD3-16*01>3'_IGHJ6*01 | 2729 | O12_IGKJ1*01 | 833 | 1438 |
| 661 | VH3-23_IGHD3-22*01>1'_IGHJ6*01 | 2730 | O12_IGKJ1*01 | 833 | 1438 |
| 662 | VH3-23_IGHD4-4*01 (1) >1'_IGHJ6*01 | 2731 | O12_IGKJ1*01 | 833 | 1438 |
| 663 | VH3-23_IGHD4-4*01 (1) >3'_IGHJ6*01 | 2732 | O12_IGKJ1*01 | 833 | 1438 |
| 664 | VH3-23_IGHD4-11*01 (1) >1'_IGHJ6*01 | 2733 | O12_IGKJ1*01 | 833 | 1438 |
| 665 | VH3-23_IGHD4-11*01 (1) >3'_IGHJ6*01 | 2734 | O12_IGKJ1*01 | 833 | 1438 |
| 666 | VH3-23_IGHD4-17*01>1'_IGHJ6*01 | 2735 | O12_IGKJ1*01 | 833 | 1438 |
| 667 | VH3-23_IGHD4-17*01>3'_IGHJ6*01 | 2736 | O12_IGKJ1*01 | 833 | 1438 |
| 668 | VH3-23_IGHD4-23*01>1'_IGHJ6*01 | 2737 | O12_IGKJ1*01 | 833 | 1438 |
| 669 | VH3-23_IGHD4-23*01>3'_IGHJ6*01 | 2738 | O12_IGKJ1*01 | 833 | 1438 |
| 670 | VH3-23_IGHD5-5*01 (2) >1'_IGHJ6*01 | 2739 | O12_IGKJ1*01 | 833 | 1438 |
| 671 | VH3-23_IGHD5-5*01 (2) >3'_IGHJ6*01 | 2740 | O12_IGKJ1*01 | 833 | 1438 |
| 672 | VH3-23_IGHD5-12*01>1'_IGHJ6*01 | 2741 | O12_IGKJ1*01 | 833 | 1438 |
| 673 | VH3-23_IGHD5-12*01>3'_IGHJ6*01 | 2742 | O12_IGKJ1*01 | 833 | 1438 |
| 674 | VH3-23_IGHD5-18*01 (2) >1'_IGHJ6*01 | 2743 | O12_IGKJ1*01 | 833 | 1438 |
| 675 | VH3-23_IGHD5-18*01 (2) >3'_IGHJ6*01 | 2744 | O12_IGKJ1*01 | 833 | 1438 |
| 676 | VH3-23_IGHD5-24*01>1'_IGHJ6*01 | 2745 | O12_IGKJ1*01 | 833 | 1438 |
| 677 | VH3-23_IGHD5-24*01>3'_IGHJ6*01 | 2746 | O12_IGKJ1*01 | 833 | 1438 |
| 678 | VH3-23_IGHD6-6*01>1'_IGHJ6*01 | 2747 | O12_IGKJ1*01 | 833 | 1438 |
| 679 | VH3-23_IGHD6-6*01>2'_IGHJ6*01 | 2748 | O12_IGKJ1*01 | 833 | 1438 |
| 680 | VH3-23_IGHD6-6*01>3'_IGHJ6*01 | 2749 | O12_IGKJ1*01 | 833 | 1438 |
| 681 | VH3-23_IGHD6-13*01>1'_IGHJ6*01 | 2750 | O12_IGKJ1*01 | 833 | 1438 |
| 682 | VH3-23_IGHD6-13*01>2'_IGHJ6*01 | 2751 | O12_IGKJ1*01 | 833 | 1438 |
| 683 | VH3-23_IGHD6-13*01>3'_IGHJ6*01 | 2752 | O12_IGKJ1*01 | 833 | 1438 |
| 684 | VH3-23_IGHD6-19*01>1'_IGHJ6*01 | 2753 | O12_IGKJ1*01 | 833 | 1438 |
| 685 | VH3-23_IGHD6-19*01>2'_IGHJ6*01 | 2754 | O12_IGKJ1*01 | 833 | 1438 |
| 686 | VH3-23_IGHD6-19*01>3'_IGHJ6*01 | 2755 | O12_IGKJ1*01 | 833 | 1438 |
| 687 | VH3-23_IGHD6-25*01>1'_IGHJ6*01 | 2756 | O12_IGKJ1*01 | 833 | 1438 |
| 688 | VH3-23_IGHD6-25*01>3'_IGHJ6*01 | 2757 | O12_IGKJ1*01 | 833 | 1438 |
| 689 | VH3-23_IGHD7-27*01>1'_IGHJ6*01 | 2758 | O12_IGKJ1*01 | 833 | 1438 |
| 690 | VH3-23_IGHD7-27*01>2'_IGHJ6*01 | 2759 | O12_IGKJ1*01 | 833 | 1438 |
| 691 | VH3-23_IGHD1-1*01>1_IGHJ1*01 | 2070 | O18_IGKJ1*01 | 834 | 1439 |
| 692 | VH3-23_IGHD1-1*01>2_IGHJ1*01 | 2071 | O18_IGKJ1*01 | 834 | 1439 |
| 693 | VH3-23_IGHD1-1*01>3_IGHJ1*01 | 2072 | O18_IGKJ1*01 | 834 | 1439 |
| 694 | VH3-23_IGHD1-7*01>1_IGHJ1*01 | 2073 | O18_IGKJ1*01 | 834 | 1439 |
| 695 | VH3-23_IGHD1-7*01>3_IGHJ1*01 | 2074 | O18_IGKJ1*01 | 834 | 1439 |
| 696 | VH3-23_IGHD1-14*01>1_IGHJ1*01 | 2075 | O18_IGKJ1*01 | 834 | 1439 |
| 697 | VH3-23_IGHD1-14*01>3_IGHJ1*01 | 2076 | O18_IGKJ1*01 | 834 | 1439 |
| 698 | VH3-23_IGHD1-20*01>1_IGHJ1*01 | 2077 | O18_IGKJ1*01 | 834 | 1439 |
| 699 | VH3-23_IGHD1-20*01>3_IGHJ1*01 | 2078 | O18_IGKJ1*01 | 834 | 1439 |
| 700 | VH3-23_IGHD1-26*01>1_IGHJ1*01 | 2079 | O18_IGKJ1*01 | 834 | 1439 |
| 701 | VH3-23_IGHD1-26*01>3_IGHJ1*01 | 2080 | O18_IGKJ1*01 | 834 | 1439 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 702 | VH3-23__IGHD2-2*01>2__IGHJ1*01 | 2081 | O18__IGKJ1*01 | 834 | 1439 |
| 703 | VH3-23__IGHD2-2*01>3__IGHJ1*01 | 2082 | O18__IGKJ1*01 | 834 | 1439 |
| 704 | VH3-23__IGHD2-8*01>2__IGHJ1*01 | 2083 | O18__IGKJ1*01 | 834 | 1439 |
| 705 | VH3-23__IGHD2-8*01>3__IGHJ1*01 | 2084 | O18__IGKJ1*01 | 834 | 1439 |
| 706 | VH3-23__IGHD2-15*01>2__IGHJ1*01 | 2085 | O18__IGKJ1*01 | 834 | 1439 |
| 707 | VH3-23__IGHD2-15*01>3__IGHJ1*01 | 2086 | O18__IGKJ1*01 | 834 | 1439 |
| 708 | VH3-23__IGHD2-21*01>2__IGHJ1*01 | 2087 | O18__IGKJ1*01 | 834 | 1439 |
| 709 | VH3-23__IGHD2-21*01>3__IGHJ1*01 | 2088 | O18__IGKJ1*01 | 834 | 1439 |
| 710 | VH3-23__IGHD3-3*01>1__IGHJ1*01 | 2089 | O18__IGKJ1*01 | 834 | 1439 |
| 711 | VH3-23__IGHD3-3*01>2__IGHJ1*01 | 2090 | O18__IGKJ1*01 | 834 | 1439 |
| 712 | VH3-23__IGHD3-3*01>3__IGHJ1*01 | 2091 | O18__IGKJ1*01 | 834 | 1439 |
| 713 | VH3-23__IGHD3-9*01>2__IGHJ1*01 | 2092 | O18__IGKJ1*01 | 834 | 1439 |
| 714 | VH3-23__IGHD3-10*01>2__IGHJ1*01 | 2093 | O18__IGKJ1*01 | 834 | 1439 |
| 715 | VH3-23__IGHD3-10*01>3__IGHJ1*01 | 2094 | O18__IGKJ1*01 | 834 | 1439 |
| 716 | VH3-23__IGHD3-16*01>2__IGHJ1*01 | 2095 | O18__IGKJ1*01 | 834 | 1439 |
| 717 | VH3-23__IGHD3-16*01>3__IGHJ1*01 | 2096 | O18__IGKJ1*01 | 834 | 1439 |
| 718 | VH3-23__IGHD3-22*01>2__IGHJ1*01 | 2097 | O18__IGKJ1*01 | 834 | 1439 |
| 719 | VH3-23__IGHD3-22*01>3__IGHJ1*01 | 2098 | O18__IGKJ1*01 | 834 | 1439 |
| 720 | VH3-23__IGHD4-4*01 (1) >2__IGHJ1*01 | 2099 | O18__IGKJ1*01 | 834 | 1439 |
| 721 | VH3-23__IGHD4-4*01 (1) >3__IGHJ1*01 | 2100 | O18__IGKJ1*01 | 834 | 1439 |
| 722 | VH3-23__IGHD4-11*01 (1) >2__IGHJ1*01 | 2101 | O18__IGKJ1*01 | 834 | 1439 |
| 723 | VH3-23__IGHD4-11*01 (1) >3__IGHJ1*01 | 2102 | O18__IGKJ1*01 | 834 | 1439 |
| 724 | VH3-23__IGHD4-17*01>2__IGHJ1*01 | 2103 | O18__IGKJ1*01 | 834 | 1439 |
| 725 | VH3-23__IGHD4-17*01>3__IGHJ1*01 | 2104 | O18__IGKJ1*01 | 834 | 1439 |
| 726 | VH3-23__IGHD4-23*01>2__IGHJ1*01 | 2105 | O18__IGKJ1*01 | 834 | 1439 |
| 727 | VH3-23__IGHD4-23*01>3__IGHJ1*01 | 2106 | O18__IGKJ1*01 | 834 | 1439 |
| 728 | VH3-23__IGHD5-5*01 (2) >1__IGHJ1*01 | 2107 | O18__IGKJ1*01 | 834 | 1439 |
| 729 | VH3-23__IGHD5-5*01 (2) >2__IGHJ1*01 | 2108 | O18__IGKJ1*01 | 834 | 1439 |
| 730 | VH3-23__IGHD5-5*01 (2) >3__IGHJ1*01 | 2109 | O18__IGKJ1*01 | 834 | 1439 |
| 731 | VH3-23__IGHD5-12*01>1__IGHJ1*01 | 2110 | O18__IGKJ1*01 | 834 | 1439 |
| 732 | VH3-23__IGHD5-12*01>3__IGHJ1*01 | 2111 | O18__IGKJ1*01 | 834 | 1439 |
| 733 | VH3-23__IGHD5-18*01 (2) >1__IGHJ1*01 | 2112 | O18__IGKJ1*01 | 834 | 1439 |
| 734 | VH3-23__IGHD5-18*01 (2) >2__IGHJ1*01 | 2113 | O18__IGKJ1*01 | 834 | 1439 |
| 735 | VH3-23__IGHD5-18*01 (2) >3__IGHJ1*01 | 2114 | O18__IGKJ1*01 | 834 | 1439 |
| 736 | VH3-23__IGHD5-24*01>1__IGHJ1*01 | 2115 | O18__IGKJ1*01 | 834 | 1439 |
| 737 | VH3-23__IGHD5-24*01>3__IGHJ1*01 | 2116 | O18__IGKJ1*01 | 834 | 1439 |
| 738 | VH3-23__IGHD6-6*01>1__IGHJ1*01 | 2117 | O18__IGKJ1*01 | 834 | 1439 |
| 739 | VH3-23__IGHD1-1*01>1'__IGHJ1*01 | 2127 | O18__IGKJ1*01 | 834 | 1439 |
| 740 | VH3-23__IGHD1-1*01>2'__IGHJ1*01 | 2128 | O18__IGKJ1*01 | 834 | 1439 |
| 741 | VH3-23__IGHD1-1*01>3'__IGHJ1*01 | 2129 | O18__IGKJ1*01 | 834 | 1439 |
| 742 | VH3-23__IGHD1-7*01>1'__IGHJ1*01 | 2130 | O18__IGKJ1*01 | 834 | 1439 |
| 743 | VH3-23__IGHD1-7*01>3'__IGHJ1*01 | 2131 | O18__IGKJ1*01 | 834 | 1439 |
| 744 | VH3-23__IGHD1-14*01>1'__IGHJ1*01 | 2132 | O18__IGKJ1*01 | 834 | 1439 |
| 745 | VH3-23__IGHD1-14*01>2'__IGHJ1*01 | 2133 | O18__IGKJ1*01 | 834 | 1439 |
| 746 | VH3-23__IGHD1-14*01>3'__IGHJ1*01 | 2134 | O18__IGKJ1*01 | 834 | 1439 |
| 747 | VH3-23__IGHD1-20*01>1'__IGHJ1*01 | 2135 | O18__IGKJ1*01 | 834 | 1439 |
| 748 | VH3-23__IGHD1-20*01>2'__IGHJ1*01 | 2136 | O18__IGKJ1*01 | 834 | 1439 |
| 749 | VH3-23__IGHD1-20*01>3'__IGHJ1*01 | 2137 | O18__IGKJ1*01 | 834 | 1439 |
| 750 | VH3-23__IGHD1-26*01>1'__IGHJ1*01 | 2138 | O18__IGKJ1*01 | 834 | 1439 |
| 751 | VH3-23__IGHD1-26*01>3'__IGHJ1*01 | 2139 | O18__IGKJ1*01 | 834 | 1439 |
| 752 | VH3-23__IGHD2-2*01>1'__IGHJ1*01 | 2140 | O18__IGKJ1*01 | 834 | 1439 |
| 753 | VH3-23__IGHD2-2*01>3'__IGHJ1*01 | 2141 | O18__IGKJ1*01 | 834 | 1439 |
| 754 | VH3-23__IGHD2-8*01>1'__IGHJ1*01 | 2142 | O18__IGKJ1*01 | 834 | 1439 |
| 755 | VH3-23__IGHD2-15*01>1'__IGHJ1*01 | 2143 | O18__IGKJ1*01 | 834 | 1439 |
| 756 | VH3-23__IGHD2-15*01>3'__IGHJ1*01 | 2144 | O18__IGKJ1*01 | 834 | 1439 |
| 757 | VH3-23__IGHD2-21*01>1'__IGHJ1*01 | 2145 | O18__IGKJ1*01 | 834 | 1439 |
| 758 | VH3-23__IGHD2-21*01>3'__IGHJ1*01 | 2146 | O18__IGKJ1*01 | 834 | 1439 |
| 759 | VH3-23__IGHD3-3*01>1'__IGHJ1*01 | 2147 | O18__IGKJ1*01 | 834 | 1439 |
| 760 | VH3-23__IGHD3-3*01>3'__IGHJ1*01 | 2148 | O18__IGKJ1*01 | 834 | 1439 |
| 761 | VH3-23__IGHD3-9*01>1'__IGHJ1*01 | 2149 | O18__IGKJ1*01 | 834 | 1439 |
| 762 | VH3-23__IGHD3-9*01>3'__IGHJ1*01 | 2150 | O18__IGKJ1*01 | 834 | 1439 |
| 763 | VH3-23__IGHD3-10*01>1'__IGHJ1*01 | 2151 | O18__IGKJ1*01 | 834 | 1439 |
| 764 | VH3-23__IGHD3-10*01>3'__IGHJ1*01 | 2152 | O18__IGKJ1*01 | 834 | 1439 |
| 765 | VH3-23__IGHD3-16*01>1'__IGHJ1*01 | 2153 | O18__IGKJ1*01 | 834 | 1439 |
| 766 | VH3-23__IGHD3-16*01>3'__IGHJ1*01 | 2154 | O18__IGKJ1*01 | 834 | 1439 |
| 767 | VH3-23__IGHD3-22*01>1'__IGHJ1*01 | 2155 | O18__IGKJ1*01 | 834 | 1439 |
| 768 | VH3-23__IGHD4-4*01 (1) >1'__IGHJ1*01 | 2156 | O18__IGKJ1*01 | 834 | 1439 |
| 769 | VH3-23__IGHD4-4*01 (1) >3'__IGHJ1*01 | 2157 | O18__IGKJ1*01 | 834 | 1439 |
| 770 | VH3-23__IGHD4-11*01 (1) >1'__IGHJ1*01 | 2158 | O18__IGKJ1*01 | 834 | 1439 |
| 771 | VH3-23__IGHD4-11*01 (1) >3'__IGHJ1*01 | 2159 | O18__IGKJ1*01 | 834 | 1439 |
| 772 | VH3-23__IGHD4-17*01>1'__IGHJ1*01 | 2160 | O18__IGKJ1*01 | 834 | 1439 |
| 773 | VH3-23__IGHD4-17*01>3'__IGHJ1*01 | 2161 | O18__IGKJ1*01 | 834 | 1439 |
| 774 | VH3-23__IGHD4-23*01>1'__IGHJ1*01 | 2162 | O18__IGKJ1*01 | 834 | 1439 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 775 | VH3-23_IGHD4-23*01>3'_IGHJ1*01 | 2163 | O18_IGKJ1*01 | 834 | 1439 |
| 776 | VH3-23_IGHD5-5*01 (2) >1'_IGHJ1*01 | 2164 | O18_IGKJ1*01 | 834 | 1439 |
| 777 | VH3-23_IGHD5-5*01 (2) >3'_IGHJ1*01 | 2165 | O18_IGKJ1*01 | 834 | 1439 |
| 778 | VH3-23_IGHD5-12*01>1'_IGHJ1*01 | 2166 | O18_IGKJ1*01 | 834 | 1439 |
| 779 | VH3-23_IGHD5-12*01>3'_IGHJ1*01 | 2167 | O18_IGKJ1*01 | 834 | 1439 |
| 780 | VH3-23_IGHD5-18*01 (2) >1'_IGHJ1*01 | 2168 | O18_IGKJ1*01 | 834 | 1439 |
| 781 | VH3-23_IGHD5-18*01 (2) >3'_IGHJ1*01 | 2169 | O18_IGKJ1*01 | 834 | 1439 |
| 782 | VH3-23_IGHD5-24*01>1'_IGHJ1*01 | 2170 | O18_IGKJ1*01 | 834 | 1439 |
| 783 | VH3-23_IGHD5-24*01>3'_IGHJ1*01 | 2171 | O18_IGKJ1*01 | 834 | 1439 |
| 784 | VH3-23_IGHD6-6*01>1'_IGHJ1*01 | 2172 | O18_IGKJ1*01 | 834 | 1439 |
| 785 | VH3-23_IGHD6-6*01>2'_IGHJ1*01 | 2173 | O18_IGKJ1*01 | 834 | 1439 |
| 786 | VH3-23_IGHD6-6*01>3'_IGHJ1*01 | 2174 | O18_IGKJ1*01 | 834 | 1439 |
| 787 | VH3-23_IGHD7-27*01>1'_IGHJ6*01 | 2758 | O18_IGKJ1*01 | 834 | 1439 |
| 788 | VH3-23_IGHD6-13*01>2_IGHJ6*01 | 2695 | O18_IGKJ1*01 | 834 | 1439 |
| 789 | VH3-23_IGHD6-19*01>1_IGHJ6*01 | 2696 | O18_IGKJ1*01 | 834 | 1439 |
| 790 | VH3-23_IGHD6-19*01>2_IGHJ6*01 | 2697 | O18_IGKJ1*01 | 834 | 1439 |
| 791 | VH3-23_IGHD6-25*01>1_IGHJ6*01 | 2698 | O18_IGKJ1*01 | 834 | 1439 |
| 792 | VH3-23_IGHD6-25*01>2_IGHJ6*01 | 2699 | O18_IGKJ1*01 | 834 | 1439 |
| 793 | VH3-23_IGHD7-27*01>1_IGHJ6*01 | 2700 | O18_IGKJ1*01 | 834 | 1439 |
| 794 | VH3-23_IGHD7-27*01>3_IGHJ6*01 | 2701 | O18_IGKJ1*01 | 834 | 1439 |
| 795 | VH3-23_IGHD6-13*01>1'_IGHJ6*01 | 2750 | O18_IGKJ1*01 | 834 | 1439 |
| 796 | VH3-23_IGHD6-13*01>2'_IGHJ6*01 | 2751 | O18_IGKJ1*01 | 834 | 1439 |
| 797 | VH3-23_IGHD6-13*01>2_IGHJ6*01_B | 2695 | O18_IGKJ1*01 | 834 | 1439 |
| 798 | VH3-23_IGHD6-19*01>1'_IGHJ6*01 | 2753 | O18_IGKJ1*01 | 834 | 1439 |
| 799 | VH3-23_IGHD6-19*01>2'_IGHJ6*01 | 2754 | O18_IGKJ1*01 | 834 | 1439 |
| 800 | VH3-23_IGHD6-25*01>1_IGHJ6*01_B | 2698 | O18_IGKJ1*01 | 834 | 1439 |
| 801 | VH3-23_IGHD6-25*01>1'_IGHJ6*01 | 2756 | O18_IGKJ1*01 | 834 | 1439 |
| 802 | VH3-23_IGHD6-25*01>3'_IGHJ6*01 | 2757 | O18_IGKJ1*01 | 834 | 1439 |
| 803 | VH3-23_IGHD7-27*01>1'_IGHJ6*01 | 2758 | O18_IGKJ1*01 | 834 | 1439 |
| 804 | VH3-23_IGHD7-27*01>2'_IGHJ6*01 | 2759 | O18_IGKJ1*01 | 834 | 1439 |
| 805 | VH3-23_IGHD7-27*01>1'_IGHJ6*01 | 2758 | A20_IGKJ1*01 | 809 | 1414 |
| 806 | VH3-23_IGHD6-13*01>2_IGHJ6*01 | 2695 | A20_IGKJ1*01 | 809 | 1414 |
| 807 | VH3-23_IGHD6-19*01>1_IGHJ6*01 | 2696 | A20_IGKJ1*01 | 809 | 1414 |
| 808 | VH3-23_IGHD6-19*01>2_IGHJ6*01 | 2697 | A20_IGKJ1*01 | 809 | 1414 |
| 809 | VH3-23_IGHD6-25*01>1_IGHJ6*01 | 2698 | A20_IGKJ1*01 | 809 | 1414 |
| 810 | VH3-23_IGHD6-25*01>2_IGHJ6*01 | 2699 | A20_IGKJ1*01 | 809 | 1414 |
| 811 | VH3-23_IGHD7-27*01>1_IGHJ6*01 | 2700 | A20_IGKJ1*01 | 809 | 1414 |
| 812 | VH3-23_IGHD7-27*01>3_IGHJ6*01 | 2701 | A20_IGKJ1*01 | 809 | 1414 |
| 813 | VH3-23_IGHD6-13*01>1'_IGHJ6*01 | 2750 | A20_IGKJ1*01 | 809 | 1414 |
| 814 | VH3-23_IGHD6-13*01>2'_IGHJ6*01 | 2751 | A20_IGKJ1*01 | 809 | 1414 |
| 815 | VH3-23_IGHD6-13*01>2_IGHJ6*01_B | 2695 | A20_IGKJ1*01 | 809 | 1414 |
| 816 | VH3-23_IGHD6-19*01>1'_IGHJ6*01 | 2753 | A20_IGKJ1*01 | 809 | 1414 |
| 817 | VH3-23_IGHD6-19*01>2'_IGHJ6*01 | 2754 | A20_IGKJ1*01 | 809 | 1414 |
| 818 | VH3-23_IGHD6-25*01>1_IGHJ6*01_B | 2698 | A20_IGKJ1*01 | 809 | 1414 |
| 819 | VH3-23_IGHD6-25*01>1'_IGHJ6*01 | 2756 | A20_IGKJ1*01 | 809 | 1414 |
| 820 | VH3-23_IGHD6-25*01>3'_IGHJ6*01 | 2757 | A20_IGKJ1*01 | 809 | 1414 |
| 821 | VH3-23_IGHD7-27*01>1'_IGHJ6*01 | 2758 | A20_IGKJ1*01 | 809 | 1414 |
| 822 | VH3-23_IGHD7-27*01>2'_IGHJ6*01 | 2759 | A20_IGKJ1*01 | 809 | 1414 |
| 823 | VH3-23_IGHD1-1*01>1_IGHJ6*01 | 2645 | L11_IGKJ1*01 | 819 | 1424 |
| 824 | VH3-23_IGHD1-1*01>2_IGHJ6*01 | 2646 | L11_IGKJ1*01 | 819 | 1424 |
| 825 | VH3-23_IGHD1-1*01>3_IGHJ6*01 | 2647 | L11_IGKJ1*01 | 819 | 1424 |
| 826 | VH3-23_IGHD1-7*01>1_IGHJ6*01 | 2648 | L11_IGKJ1*01 | 819 | 1424 |
| 827 | VH3-23_IGHD1-7*01>3_IGHJ6*01 | 2649 | L11_IGKJ1*01 | 819 | 1424 |
| 828 | VH3-23_IGHD1-14*01>1_IGHJ6*01 | 2650 | L11_IGKJ1*01 | 819 | 1424 |
| 829 | VH3-23_IGHD1-14*01>3_IGHJ6*01 | 2651 | L11_IGKJ1*01 | 819 | 1424 |
| 830 | VH3-23_IGHD1-20*01>1_IGHJ6*01 | 2652 | L11_IGKJ1*01 | 819 | 1424 |
| 831 | VH3-23_IGHD1-20*01>3_IGHJ6*01 | 2653 | L11_IGKJ1*01 | 819 | 1424 |
| 832 | VH3-23_IGHD1-26*01>1_IGHJ6*01 | 2654 | L11_IGKJ1*01 | 819 | 1424 |
| 833 | VH3-23_IGHD1-26*01>3_IGHJ6*01 | 2655 | L11_IGKJ1*01 | 819 | 1424 |
| 834 | VH3-23_IGHD2-2*01>2_IGHJ6*01 | 2656 | L11_IGKJ1*01 | 819 | 1424 |
| 835 | VH3-23_IGHD2-2*01>3_IGHJ6*01 | 2657 | L11_IGKJ1*01 | 819 | 1424 |
| 836 | VH3-23_IGHD2-8*01>2_IGHJ6*01 | 2658 | L11_IGKJ1*01 | 819 | 1424 |
| 837 | VH3-23_IGHD2-8*01>3_IGHJ6*01 | 2659 | L11_IGKJ1*01 | 819 | 1424 |
| 838 | VH3-23_IGHD2-15*01>2_IGHJ6*01 | 2660 | L11_IGKJ1*01 | 819 | 1424 |
| 839 | VH3-23_IGHD2-15*01>3_IGHJ6*01 | 2661 | L11_IGKJ1*01 | 819 | 1424 |
| 840 | VH3-23_IGHD2-21*01>2_IGHJ6*01 | 2662 | L11_IGKJ1*01 | 819 | 1424 |
| 841 | VH3-23_IGHD2-21*01>3_IGHJ6*01 | 2663 | L11_IGKJ1*01 | 819 | 1424 |
| 842 | VH3-23_IGHD3-3*01>1_IGHJ6*01 | 2664 | L11_IGKJ1*01 | 819 | 1424 |
| 843 | VH3-23_IGHD3-3*01>2_IGHJ6*01 | 2665 | L11_IGKJ1*01 | 819 | 1424 |
| 844 | VH3-23_IGHD3-3*01>3_IGHJ6*01 | 2666 | L11_IGKJ1*01 | 819 | 1424 |
| 845 | VH3-23_IGHD3-9*01>2_IGHJ6*01 | 2667 | L11_IGKJ1*01 | 819 | 1424 |
| 846 | VH3-23_IGHD3-10*01>2_IGHJ6*01 | 2668 | L11_IGKJ1*01 | 819 | 1424 |
| 847 | VH3-23_IGHD3-10*01>3_IGHJ6*01 | 2669 | L11_IGKJ1*01 | 819 | 1424 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 848 | VH3-23_IGHD3-16*01>2_IGHJ6*01 | 2670 | L11_IGKJ1*01 | 819 | 1424 |
| 849 | VH3-23_IGHD3-16*01>3_IGHJ6*01 | 2671 | L11_IGKJ1*01 | 819 | 1424 |
| 850 | VH3-23_IGHD3-22*01>2_IGHJ6*01 | 2672 | L11_IGKJ1*01 | 819 | 1424 |
| 851 | VH3-23_IGHD3-22*01>3_IGHJ6*01 | 2673 | L11_IGKJ1*01 | 819 | 1424 |
| 852 | VH3-23_IGHD4-4*01 (1) >2_IGHJ6*01 | 2674 | L11_IGKJ1*01 | 819 | 1424 |
| 853 | VH3-23_IGHD4-4*01 (1) >3_IGHJ6*01 | 2675 | L11_IGKJ1*01 | 819 | 1424 |
| 854 | VH3-23_IGHD4-11*01 (1) >2_IGHJ6*01 | 2676 | L11_IGKJ1*01 | 819 | 1424 |
| 855 | VH3-23_IGHD4-11*01 (1) >3_IGHJ6*01 | 2677 | L11_IGKJ1*01 | 819 | 1424 |
| 856 | VH3-23_IGHD4-17*01>2_IGHJ6*01 | 2678 | L11_IGKJ1*01 | 819 | 1424 |
| 857 | VH3-23_IGHD4-17*01>3_IGHJ6*01 | 2679 | L11_IGKJ1*01 | 819 | 1424 |
| 858 | VH3-23_IGHD4-23*01>2_IGHJ6*01 | 2680 | L11_IGKJ1*01 | 819 | 1424 |
| 859 | VH3-23_IGHD4-23*01>3_IGHJ6*01 | 2681 | L11_IGKJ1*01 | 819 | 1424 |
| 860 | VH3-23_IGHD5-5*01 (2) >1_IGHJ6*01 | 2682 | L11_IGKJ1*01 | 819 | 1424 |
| 861 | VH3-23_IGHD5-5*01 (2) >2_IGHJ6*01 | 2683 | L11_IGKJ1*01 | 819 | 1424 |
| 862 | VH3-23_IGHD5-5*01 (2) >3_IGHJ6*01 | 2684 | L11_IGKJ1*01 | 819 | 1424 |
| 863 | VH3-23_IGHD5-12*01>1_IGHJ6*01 | 2685 | L11_IGKJ1*01 | 819 | 1424 |
| 864 | VH3-23_IGHD5-12*01>3_IGHJ6*01 | 2686 | L11_IGKJ1*01 | 819 | 1424 |
| 865 | VH3-23_IGHD5-18*01 (2) >1_IGHJ6*01 | 2687 | L11_IGKJ1*01 | 819 | 1424 |
| 866 | VH3-23_IGHD5-18*01 (2) >2_IGHJ6*01 | 2688 | L11_IGKJ1*01 | 819 | 1424 |
| 867 | VH3-23_IGHD5-18*01 (2) >3_IGHJ6*01 | 2689 | L11_IGKJ1*01 | 819 | 1424 |
| 868 | VH3-23_IGHD5-24*01>1_IGHJ6*01 | 2690 | L11_IGKJ1*01 | 819 | 1424 |
| 869 | VH3-23_IGHD5-24*01>3_IGHJ6*01 | 2691 | L11_IGKJ1*01 | 819 | 1424 |
| 870 | VH3-23_IGHD6-6*01>1_IGHJ6*01 | 2692 | L11_IGKJ1*01 | 819 | 1424 |
| 871 | VH3-23_IGHD1-1*01>1'_IGHJ6*01 | 2702 | L11_IGKJ1*01 | 819 | 1424 |
| 872 | VH3-23_IGHD1-1*01>2'_IGHJ6*01 | 2703 | L11_IGKJ1*01 | 819 | 1424 |
| 873 | VH3-23_IGHD1-1*01>3'_IGHJ6*01 | 2704 | L11_IGKJ1*01 | 819 | 1424 |
| 874 | VH3-23_IGHD1-7*01>1'_IGHJ6*01 | 2705 | L11_IGKJ1*01 | 819 | 1424 |
| 875 | VH3-23_IGHD1-7*01>3'_IGHJ6*01 | 2706 | L11_IGKJ1*01 | 819 | 1424 |
| 876 | VH3-23_IGHD1-14*01>1'_IGHJ6*01 | 2707 | L11_IGKJ1*01 | 819 | 1424 |
| 877 | VH3-23_IGHD1-14*01>2'_IGHJ6*01 | 2708 | L11_IGKJ1*01 | 819 | 1424 |
| 878 | VH3-23_IGHD1-14*01>3'_IGHJ6*01 | 2709 | L11_IGKJ1*01 | 819 | 1424 |
| 879 | VH3-23_IGHD1-20*01>1'_IGHJ6*01 | 2710 | L11_IGKJ1*01 | 819 | 1424 |
| 880 | VH3-23_IGHD1-20*01>2'_IGHJ6*01 | 2711 | L11_IGKJ1*01 | 819 | 1424 |
| 881 | VH3-23_IGHD1-20*01>3'_IGHJ6*01 | 2712 | L11_IGKJ1*01 | 819 | 1424 |
| 882 | VH3-23_IGHD1-26*01>1'_IGHJ6*01 | 2713 | L11_IGKJ1*01 | 819 | 1424 |
| 883 | VH3-23_IGHD1-26*01>1'_IGHJ6*01_B | 2714 | L11_IGKJ1*01 | 819 | 1424 |
| 884 | VH3-23_IGHD2-2*01>2'_IGHJ6*01_B | 2715 | L11_IGKJ1*01 | 819 | 1424 |
| 885 | VH3-23_IGHD2-2*01>3'_IGHJ6*01 | 2716 | L11_IGKJ1*01 | 819 | 1424 |
| 886 | VH3-23_IGHD2-8*01>1'_IGHJ6*01 | 2717 | L11_IGKJ1*01 | 819 | 1424 |
| 887 | VH3-23_IGHD2-15*01>1'_IGHJ6*01 | 2718 | L11_IGKJ1*01 | 819 | 1424 |
| 888 | VH3-23_IGHD2-15*01>3'_IGHJ6*01 | 2719 | L11_IGKJ1*01 | 819 | 1424 |
| 889 | VH3-23_IGHD2-21*01>1'_IGHJ6*01 | 2720 | L11_IGKJ1*01 | 819 | 1424 |
| 890 | VH3-23_IGHD2-21*01>3'_IGHJ6*01 | 2721 | L11_IGKJ1*01 | 819 | 1424 |
| 891 | VH3-23_IGHD3-3*01>1'_IGHJ6*01 | 2722 | L11_IGKJ1*01 | 819 | 1424 |
| 892 | VH3-23_IGHD3-3*01>3'_IGHJ6*01 | 2723 | L11_IGKJ1*01 | 819 | 1424 |
| 893 | VH3-23_IGHD3-9*01>1'_IGHJ6*01 | 2724 | L11_IGKJ1*01 | 819 | 1424 |
| 894 | VH3-23_IGHD3-9*01>3'_IGHJ6*01 | 2725 | L11_IGKJ1*01 | 819 | 1424 |
| 895 | VH3-23_IGHD3-10*01>1'_IGHJ6*01 | 2726 | L11_IGKJ1*01 | 819 | 1424 |
| 896 | VH3-23_IGHD3-10*01>3'_IGHJ6*01 | 2727 | L11_IGKJ1*01 | 819 | 1424 |
| 897 | VH3-23_IGHD3-16*01>1'_IGHJ6*01 | 2728 | L11_IGKJ1*01 | 819 | 1424 |
| 898 | VH3-23_IGHD3-16*01>3'_IGHJ6*01 | 2729 | L11_IGKJ1*01 | 819 | 1424 |
| 899 | VH3-23_IGHD3-22*01>1'_IGHJ6*01 | 2730 | L11_IGKJ1*01 | 819 | 1424 |
| 900 | VH3-23_IGHD4-4*01 (1) >1'_IGHJ6*01 | 2731 | L11_IGKJ1*01 | 819 | 1424 |
| 901 | VH3-23_IGHD4-4*01 (1) >3'_IGHJ6*01 | 2732 | L11_IGKJ1*01 | 819 | 1424 |
| 902 | VH3-23_IGHD4-11*01 (1) >1'_IGHJ6*01 | 2733 | L11_IGKJ1*01 | 819 | 1424 |
| 903 | VH3-23_IGHD4-11*01 (1) >3'_IGHJ6*01 | 2734 | L11_IGKJ1*01 | 819 | 1424 |
| 904 | VH3-23_IGHD4-17*01>1'_IGHJ6*01 | 2735 | L11_IGKJ1*01 | 819 | 1424 |
| 905 | VH3-23_IGHD4-17*01>3'_IGHJ6*01 | 2736 | L11_IGKJ1*01 | 819 | 1424 |
| 906 | VH3-23_IGHD4-23*01>1'_IGHJ6*01 | 2737 | L11_IGKJ1*01 | 819 | 1424 |
| 907 | VH3-23_IGHD4-23*01>3'_IGHJ6*01 | 2738 | L11_IGKJ1*01 | 819 | 1424 |
| 908 | VH3-23_IGHD5-5*01 (2) >1'_IGHJ6*01 | 2739 | L11_IGKJ1*01 | 819 | 1424 |
| 909 | VH3-23_IGHD5-5*01 (2) >3'_IGHJ6*01 | 2740 | L11_IGKJ1*01 | 819 | 1424 |
| 910 | VH3-23_IGHD5-12*01>1'_IGHJ6*01 | 2741 | L11_IGKJ1*01 | 819 | 1424 |
| 911 | VH3-23_IGHD5-12*01>3'_IGHJ6*01 | 2742 | L11_IGKJ1*01 | 819 | 1424 |
| 912 | VH3-23_IGHD5-18*01 (2) >1'_IGHJ6*01 | 2743 | L11_IGKJ1*01 | 819 | 1424 |
| 913 | VH3-23_IGHD5-18*01 (2) >3'_IGHJ6*01 | 2744 | L11_IGKJ1*01 | 819 | 1424 |
| 914 | VH3-23_IGHD5-24*01>1'_IGHJ6*01 | 2745 | L11_IGKJ1*01 | 819 | 1424 |
| 915 | VH3-23_IGHD5-24*01>3'_IGHJ6*01 | 2746 | L11_IGKJ1*01 | 819 | 1424 |
| 916 | VH3-23_IGHD6-6*01>1'_IGHJ6*01 | 2747 | L11_IGKJ1*01 | 819 | 1424 |
| 917 | VH3-23_IGHD6-6*01>2'_IGHJ6*01 | 2748 | L11_IGKJ1*01 | 819 | 1424 |
| 918 | VH3-23_IGHD6-6*01>3'_IGHJ6*01 | 2749 | L11_IGKJ1*01 | 819 | 1424 |
| 919 | VH3-23_IGHD1-1*01>1_IGHJ6*01 | 2645 | L12_IGKJ1*01 | 820 | 1425 |
| 920 | VH3-23_IGHD1-1*01>2_IGHJ6*01 | 2646 | L12_IGKJ1*01 | 820 | 1425 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 921 | VH3-23_IGHD1-1*01>3_IGHJ6*01 | 2647 | L12_IGKJ1*01 | 820 | 1425 |
| 922 | VH3-23_IGHD1-7*01>1_IGHJ6*01 | 2648 | L12_IGKJ1*01 | 820 | 1425 |
| 923 | VH3-23_IGHD1-7*01>3_IGHJ6*01 | 2649 | L12_IGKJ1*01 | 820 | 1425 |
| 924 | VH3-23_IGHD1-14*01>1_IGHJ6*01 | 2650 | L12_IGKJ1*01 | 820 | 1425 |
| 925 | VH3-23_IGHD1-14*01>3_IGHJ6*01 | 2651 | L12_IGKJ1*01 | 820 | 1425 |
| 926 | VH3-23_IGHD1-20*01>1_IGHJ6*01 | 2652 | L12_IGKJ1*01 | 820 | 1425 |
| 927 | VH3-23_IGHD1-20*01>3_IGHJ6*01 | 2653 | L12_IGKJ1*01 | 820 | 1425 |
| 928 | VH3-23_IGHD1-26*01>1_IGHJ6*01 | 2654 | L12_IGKJ1*01 | 820 | 1425 |
| 929 | VH3-23_IGHD1-26*01>3_IGHJ6*01 | 2655 | L12_IGKJ1*01 | 820 | 1425 |
| 930 | VH3-23_IGHD2-2*01>2_IGHJ6*01 | 2656 | L12_IGKJ1*01 | 820 | 1425 |
| 931 | VH3-23_IGHD2-2*01>3_IGHJ6*01 | 2657 | L12_IGKJ1*01 | 820 | 1425 |
| 932 | VH3-23_IGHD2-8*01>2_IGHJ6*01 | 2658 | L12_IGKJ1*01 | 820 | 1425 |
| 933 | VH3-23_IGHD2-8*01>3_IGHJ6*01 | 2659 | L12_IGKJ1*01 | 820 | 1425 |
| 934 | VH3-23_IGHD2-15*01>2_IGHJ6*01 | 2660 | L12_IGKJ1*01 | 820 | 1425 |
| 935 | VH3-23_IGHD2-15*01>3_IGHJ6*01 | 2661 | L12_IGKJ1*01 | 820 | 1425 |
| 936 | VH3-23_IGHD2-21*01>2_IGHJ6*01 | 2662 | L12_IGKJ1*01 | 820 | 1425 |
| 937 | VH3-23_IGHD2-21*01>3_IGHJ6*01 | 2663 | L12_IGKJ1*01 | 820 | 1425 |
| 938 | VH3-23_IGHD3-3*01>1_IGHJ6*01 | 2664 | L12_IGKJ1*01 | 820 | 1425 |
| 939 | VH3-23_IGHD3-3*01>2_IGHJ6*01 | 2665 | L12_IGKJ1*01 | 820 | 1425 |
| 940 | VH3-23_IGHD3-3*01>3_IGHJ6*01 | 2666 | L12_IGKJ1*01 | 820 | 1425 |
| 941 | VH3-23_IGHD3-9*01>2_IGHJ6*01 | 2667 | L12_IGKJ1*01 | 820 | 1425 |
| 942 | VH3-23_IGHD3-10*01>2_IGHJ6*01 | 2668 | L12_IGKJ1*01 | 820 | 1425 |
| 943 | VH3-23_IGHD3-10*01>3_IGHJ6*01 | 2669 | L12_IGKJ1*01 | 820 | 1425 |
| 944 | VH3-23_IGHD3-16*01>2_IGHJ6*01 | 2670 | L12_IGKJ1*01 | 820 | 1425 |
| 945 | VH3-23_IGHD3-16*01>3_IGHJ6*01 | 2671 | L12_IGKJ1*01 | 820 | 1425 |
| 946 | VH3-23_IGHD3-22*01>2_IGHJ6*01 | 2672 | L12_IGKJ1*01 | 820 | 1425 |
| 947 | VH3-23_IGHD3-22*01>3_IGHJ6*01 | 2673 | L12_IGKJ1*01 | 820 | 1425 |
| 948 | VH3-23_IGHD4-4*01 (1) >2_IGHJ6*01 | 2674 | L12_IGKJ1*01 | 820 | 1425 |
| 949 | VH3-23_IGHD4-4*01 (1) >3_IGHJ6*01 | 2675 | L12_IGKJ1*01 | 820 | 1425 |
| 950 | VH3-23_IGHD4-11*01 (1) >2_IGHJ6*01 | 2676 | L12_IGKJ1*01 | 820 | 1425 |
| 951 | VH3-23_IGHD4-11*01 (1) >3_IGHJ6*01 | 2677 | L12_IGKJ1*01 | 820 | 1425 |
| 952 | VH3-23_IGHD4-17*01>2_IGHJ6*01 | 2678 | L12_IGKJ1*01 | 820 | 1425 |
| 953 | VH3-23_IGHD4-17*01>3_IGHJ6*01 | 2679 | L12_IGKJ1*01 | 820 | 1425 |
| 954 | VH3-23_IGHD4-23*01>2_IGHJ6*01 | 2680 | L12_IGKJ1*01 | 820 | 1425 |
| 955 | VH3-23_IGHD4-23*01>3_IGHJ6*01 | 2681 | L12_IGKJ1*01 | 820 | 1425 |
| 956 | VH3-23_IGHD5-5*01 (2) >1_IGHJ6*01 | 2682 | L12_IGKJ1*01 | 820 | 1425 |
| 957 | VH3-23_IGHD5-5*01 (2) >2_IGHJ6*01 | 2683 | L12_IGKJ1*01 | 820 | 1425 |
| 958 | VH3-23_IGHD5-5*01 (2) >3_IGHJ6*01 | 2684 | L12_IGKJ1*01 | 820 | 1425 |
| 959 | VH3-23_IGHD5-12*01>1_IGHJ6*01 | 2685 | L12_IGKJ1*01 | 820 | 1425 |
| 960 | VH3-23_IGHD5-12*01>3_IGHJ6*01 | 2686 | L12_IGKJ1*01 | 820 | 1425 |
| 961 | VH3-23_IGHD5-18*01 (2) >1_IGHJ6*01 | 2687 | L12_IGKJ1*01 | 820 | 1425 |
| 962 | VH3-23_IGHD5-18*01 (2) >2_IGHJ6*01 | 2688 | L12_IGKJ1*01 | 820 | 1425 |
| 963 | VH3-23_IGHD5-18*01 (2) >3_IGHJ6*01 | 2689 | L12_IGKJ1*01 | 820 | 1425 |
| 964 | VH3-23_IGHD5-24*01>1_IGHJ6*01 | 2690 | L12_IGKJ1*01 | 820 | 1425 |
| 965 | VH3-23_IGHD5-24*01>3_IGHJ6*01 | 2691 | L12_IGKJ1*01 | 820 | 1425 |
| 966 | VH3-23_IGHD6-6*01>1_IGHJ6*01 | 2692 | L12_IGKJ1*01 | 820 | 1425 |
| 967 | VH3-23_IGHD1-1*01>1'_IGHJ6*01 | 2702 | L12_IGKJ1*01 | 820 | 1425 |
| 968 | VH3-23_IGHD1-1*01>2'_IGHJ6*01 | 2703 | L12_IGKJ1*01 | 820 | 1425 |
| 969 | VH3-23_IGHD1-1*01>3'_IGHJ6*01 | 2704 | L12_IGKJ1*01 | 820 | 1425 |
| 970 | VH3-23_IGHD1-7*01>1'_IGHJ6*01 | 2705 | L12_IGKJ1*01 | 820 | 1425 |
| 971 | VH3-23_IGHD1-7*01>3'_IGHJ6*01 | 2706 | L12_IGKJ1*01 | 820 | 1425 |
| 972 | VH3-23_IGHD1-14*01>1'_IGHJ6*01 | 2707 | L12_IGKJ1*01 | 820 | 1425 |
| 973 | VH3-23_IGHD1-14*01>2'_IGHJ6*01 | 2708 | L12_IGKJ1*01 | 820 | 1425 |
| 974 | VH3-23_IGHD1-14*01>3'_IGHJ6*01 | 2709 | L12_IGKJ1*01 | 820 | 1425 |
| 975 | VH3-23_IGHD1-20*01>1'_IGHJ6*01 | 2710 | L12_IGKJ1*01 | 820 | 1425 |
| 976 | VH3-23_IGHD1-20*01>2'_IGHJ6*01 | 2711 | L12_IGKJ1*01 | 820 | 1425 |
| 977 | VH3-23_IGHD1-20*01>3'_IGHJ6*01 | 2712 | L12_IGKJ1*01 | 820 | 1425 |
| 978 | VH3-23_IGHD1-26*01>1'_IGHJ6*01 | 2713 | L12_IGKJ1*01 | 820 | 1425 |
| 979 | VH3-23_IGHD1-26*01>1'_IGHJ6*01_B | 2714 | L12_IGKJ1*01 | 820 | 1425 |
| 980 | VH3-23_IGHD2-2*01>2_IGHJ6*01_B | 2715 | L12_IGKJ1*01 | 820 | 1425 |
| 981 | VH3-23_IGHD2-2*01>3'_IGHJ6*01 | 2716 | L12_IGKJ1*01 | 820 | 1425 |
| 982 | VH3-23_IGHD2-8*01>1'_IGHJ6*01 | 2717 | L12_IGKJ1*01 | 820 | 1425 |
| 983 | VH3-23_IGHD2-15*01>1'_IGHJ6*01 | 2718 | L12_IGKJ1*01 | 820 | 1425 |
| 984 | VH3-23_IGHD2-15*01>3'_IGHJ6*01 | 2719 | L12_IGKJ1*01 | 820 | 1425 |
| 985 | VH3-23_IGHD2-21*01>1'_IGHJ6*01 | 2720 | L12_IGKJ1*01 | 820 | 1425 |
| 986 | VH3-23_IGHD2-21*01>3'_IGHJ6*01 | 2721 | L12_IGKJ1*01 | 820 | 1425 |
| 987 | VH3-23_IGHD3-3*01>1'_IGHJ6*01 | 2722 | L12_IGKJ1*01 | 820 | 1425 |
| 988 | VH3-23_IGHD3-3*01>3'_IGHJ6*01 | 2723 | L12_IGKJ1*01 | 820 | 1425 |
| 989 | VH3-23_IGHD3-9*01>1'_IGHJ6*01 | 2724 | L12_IGKJ1*01 | 820 | 1425 |
| 990 | VH3-23_IGHD3-9*01>3'_IGHJ6*01 | 2725 | L12_IGKJ1*01 | 820 | 1425 |
| 991 | VH3-23_IGHD3-10*01>1'_IGHJ6*01 | 2726 | L12_IGKJ1*01 | 820 | 1425 |
| 992 | VH3-23_IGHD3-10*01>3'_IGHJ6*01 | 2727 | L12_IGKJ1*01 | 820 | 1425 |
| 993 | VH3-23_IGHD3-16*01>1'_IGHJ6*01 | 2728 | L12_IGKJ1*01 | 820 | 1425 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 994 | VH3-23_IGHD3-16*01>3'_IGHJ6*01 | 2729 | L12_IGKJ1*01 | 820 | 1425 |
| 995 | VH3-23_IGHD3-22*01>1'_IGHJ6*01 | 2730 | L12_IGKJ1*01 | 820 | 1425 |
| 996 | VH3-23_IGHD4-4*01 (1) >1'_IGHJ6*01 | 2731 | L12_IGKJ1*01 | 820 | 1425 |
| 997 | VH3-23_IGHD4-4*01 (1) >3'_IGHJ6*01 | 2732 | L12_IGKJ1*01 | 820 | 1425 |
| 998 | VH3-23_IGHD4-11*01 (1) >1'_IGHJ6*01 | 2733 | L12_IGKJ1*01 | 820 | 1425 |
| 999 | VH3-23_IGHD4-11*01 (1) >3'_IGHJ6*01 | 2734 | L12_IGKJ1*01 | 820 | 1425 |
| 1000 | VH3-23_IGHD4-17*01>1'_IGHJ6*01 | 2735 | L12_IGKJ1*01 | 820 | 1425 |
| 1001 | VH3-23_IGHD4-17*01>3'_IGHJ6*01 | 2736 | L12_IGKJ1*01 | 820 | 1425 |
| 1002 | VH3-23_IGHD4-23*01>1'_IGHJ6*01 | 2737 | L12_IGKJ1*01 | 820 | 1425 |
| 1003 | VH3-23_IGHD4-23*01>3'_IGHJ6*01 | 2738 | L12_IGKJ1*01 | 820 | 1425 |
| 1004 | VH3-23_IGHD5-5*01 (2) >1'_IGHJ6*01 | 2739 | L12_IGKJ1*01 | 820 | 1425 |
| 1005 | VH3-23_IGHD5-5*01 (2) >3'_IGHJ6*01 | 2740 | L12_IGKJ1*01 | 820 | 1425 |
| 1006 | VH3-23_IGHD5-12*01>1'_IGHJ6*01 | 2741 | L12_IGKJ1*01 | 820 | 1425 |
| 1007 | VH3-23_IGHD5-12*01>3'_IGHJ6*01 | 2742 | L12_IGKJ1*01 | 820 | 1425 |
| 1008 | VH3-23_IGHD5-18*01 (2) >1'_IGHJ6*01 | 2743 | L12_IGKJ1*01 | 820 | 1425 |
| 1009 | VH3-23_IGHD5-18*01 (2) >3'_IGHJ6*01 | 2744 | L12_IGKJ1*01 | 820 | 1425 |
| 1010 | VH3-23_IGHD5-24*01>1'_IGHJ6*01 | 2745 | L12_IGKJ1*01 | 820 | 1425 |
| 1011 | VH3-23_IGHD5-24*01>3'_IGHJ6*01 | 2746 | L12_IGKJ1*01 | 820 | 1425 |
| 1012 | VH3-23_IGHD6-6*01>1'_IGHJ6*01 | 2747 | L12_IGKJ1*01 | 820 | 1425 |
| 1013 | VH3-23_IGHD6-6*01>2'_IGHJ6*01 | 2748 | L12_IGKJ1*01 | 820 | 1425 |
| 1014 | VH3-23_IGHD6-6*01>3'_IGHJ6*01 | 2749 | L12_IGKJ1*01 | 820 | 1425 |
| 1015 | VH3-23_IGHD1-1*01>1_IGHJ6*01 | 2645 | O1_IGKJ1*01 | 832 | 1437 |
| 1016 | VH3-23_IGHD1-1*01>2_IGHJ6*01 | 2646 | O1_IGKJ1*01 | 832 | 1437 |
| 1017 | VH3-23_IGHD1-1*01>3_IGHJ6*01 | 2647 | O1_IGKJ1*01 | 832 | 1437 |
| 1018 | VH3-23_IGHD1-7*01>1_IGHJ6*01 | 2648 | O1_IGKJ1*01 | 832 | 1437 |
| 1019 | VH3-23_IGHD1-7*01>3_IGHJ6*01 | 2649 | O1_IGKJ1*01 | 832 | 1437 |
| 1020 | VH3-23_IGHD1-14*01>1_IGHJ6*01 | 2650 | O1_IGKJ1*01 | 832 | 1437 |
| 1021 | VH3-23_IGHD1-14*01>3_IGHJ6*01 | 2651 | O1_IGKJ1*01 | 832 | 1437 |
| 1022 | VH3-23_IGHD1-20*01>1_IGHJ6*01 | 2652 | O1_IGKJ1*01 | 832 | 1437 |
| 1023 | VH3-23_IGHD1-20*01>3_IGHJ6*01 | 2653 | O1_IGKJ1*01 | 832 | 1437 |
| 1024 | VH3-23_IGHD1-26*01>1_IGHJ6*01 | 2654 | O1_IGKJ1*01 | 832 | 1437 |
| 1025 | VH3-23_IGHD1-26*01>3_IGHJ6*01 | 2655 | O1_IGKJ1*01 | 832 | 1437 |
| 1026 | VH3-23_IGHD2-2*01>2_IGHJ6*01 | 2656 | O1_IGKJ1*01 | 832 | 1437 |
| 1027 | VH3-23_IGHD2-2*01>3_IGHJ6*01 | 2657 | O1_IGKJ1*01 | 832 | 1437 |
| 1028 | VH3-23_IGHD2-8*01>2_IGHJ6*01 | 2658 | O1_IGKJ1*01 | 832 | 1437 |
| 1029 | VH3-23_IGHD2-8*01>3_IGHJ6*01 | 2659 | O1_IGKJ1*01 | 832 | 1437 |
| 1030 | VH3-23_IGHD2-15*01>2_IGHJ6*01 | 2660 | O1_IGKJ1*01 | 832 | 1437 |
| 1031 | VH3-23_IGHD2-15*01>3_IGHJ6*01 | 2661 | O1_IGKJ1*01 | 832 | 1437 |
| 1032 | VH3-23_IGHD2-21*01>2_IGHJ6*01 | 2662 | O1_IGKJ1*01 | 832 | 1437 |
| 1033 | VH3-23_IGHD2-21*01>3_IGHJ6*01 | 2663 | O1_IGKJ1*01 | 832 | 1437 |
| 1034 | VH3-23_IGHD3-3*01>1_IGHJ6*01 | 2664 | O1_IGKJ1*01 | 832 | 1437 |
| 1035 | VH3-23_IGHD3-3*01>2_IGHJ6*01 | 2665 | O1_IGKJ1*01 | 832 | 1437 |
| 1036 | VH3-23_IGHD3-3*01>3_IGHJ6*01 | 2666 | O1_IGKJ1*01 | 832 | 1437 |
| 1037 | VH3-23_IGHD3-9*01>2_IGHJ6*01 | 2667 | O1_IGKJ1*01 | 832 | 1437 |
| 1038 | VH3-23_IGHD3-10*01>2_IGHJ6*01 | 2668 | O1_IGKJ1*01 | 832 | 1437 |
| 1039 | VH3-23_IGHD3-10*01>3_IGHJ6*01 | 2669 | O1_IGKJ1*01 | 832 | 1437 |
| 1040 | VH3-23_IGHD3-16*01>2_IGHJ6*01 | 2670 | O1_IGKJ1*01 | 832 | 1437 |
| 1041 | VH3-23_IGHD3-16*01>3_IGHJ6*01 | 2671 | O1_IGKJ1*01 | 832 | 1437 |
| 1042 | VH3-23_IGHD3-22*01>2_IGHJ6*01 | 2672 | O1_IGKJ1*01 | 832 | 1437 |
| 1043 | VH3-23_IGHD3-22*01>3_IGHJ6*01 | 2673 | O1_IGKJ1*01 | 832 | 1437 |
| 1044 | VH3-23_IGHD4-4*01 (1) >2_IGHJ6*01 | 2674 | O1_IGKJ1*01 | 832 | 1437 |
| 1045 | VH3-23_IGHD4-4*01 (1) >3_IGHJ6*01 | 2675 | O1_IGKJ1*01 | 832 | 1437 |
| 1046 | VH3-23_IGHD4-11*01 (1) >2_IGHJ6*01 | 2676 | O1_IGKJ1*01 | 832 | 1437 |
| 1047 | VH3-23_IGHD4-11*01 (1) >3_IGHJ6*01 | 2677 | O1_IGKJ1*01 | 832 | 1437 |
| 1048 | VH3-23_IGHD4-17*01>2_IGHJ6*01 | 2678 | O1_IGKJ1*01 | 832 | 1437 |
| 1049 | VH3-23_IGHD4-17*01>3_IGHJ6*01 | 2679 | O1_IGKJ1*01 | 832 | 1437 |
| 1050 | VH3-23_IGHD4-23*01>2_IGHJ6*01 | 2680 | O1_IGKJ1*01 | 832 | 1437 |
| 1051 | VH3-23_IGHD4-23*01>3_IGHJ6*01 | 2681 | O1_IGKJ1*01 | 832 | 1437 |
| 1052 | VH3-23_IGHD5-5*01 (2) >1_IGHJ6*01 | 2682 | O1_IGKJ1*01 | 832 | 1437 |
| 1053 | VH3-23_IGHD5-5*01 (2) >2_IGHJ6*01 | 2683 | O1_IGKJ1*01 | 832 | 1437 |
| 1054 | VH3-23_IGHD5-5*01 (2) >3_IGHJ6*01 | 2684 | O1_IGKJ1*01 | 832 | 1437 |
| 1055 | VH3-23_IGHD5-12*01>1_IGHJ6*01 | 2685 | O1_IGKJ1*01 | 832 | 1437 |
| 1056 | VH3-23_IGHD5-12*01>3_IGHJ6*01 | 2686 | O1_IGKJ1*01 | 832 | 1437 |
| 1057 | VH3-23_IGHD5-18*01 (2) >1_IGHJ6*01 | 2687 | O1_IGKJ1*01 | 832 | 1437 |
| 1058 | VH3-23_IGHD5-18*01 (2) >2_IGHJ6*01 | 2688 | O1_IGKJ1*01 | 832 | 1437 |
| 1059 | VH3-23_IGHD5-18*01 (2) >3_IGHJ6*01 | 2689 | O1_IGKJ1*01 | 832 | 1437 |
| 1060 | VH3-23_IGHD5-24*01>1_IGHJ6*01 | 2690 | O1_IGKJ1*01 | 832 | 1437 |
| 1061 | VH3-23_IGHD5-24*01>3_IGHJ6*01 | 2691 | O1_IGKJ1*01 | 832 | 1437 |
| 1062 | VH3-23_IGHD6-6*01>1_IGHJ6*01 | 2692 | O1_IGKJ1*01 | 832 | 1437 |
| 1063 | VH3-23_IGHD1-1*01>1'_IGHJ6*01 | 2702 | O1_IGKJ1*01 | 832 | 1437 |
| 1064 | VH3-23_IGHD1-1*01>2'_IGHJ6*01 | 2703 | O1_IGKJ1*01 | 832 | 1437 |
| 1065 | VH3-23_IGHD1-1*01>3'_IGHJ6*01 | 2704 | O1_IGKJ1*01 | 832 | 1437 |
| 1066 | VH3-23_IGHD1-7*01>1'_IGHJ6*01 | 2705 | O1_IGKJ1*01 | 832 | 1437 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 1067 | VH3-23_IGHD1-7*01>3'_IGHJ6*01 | 2706 | O1_IGKJ1*01 | 832 | 1437 |
| 1068 | VH3-23_IGHD1-14*01>1'_IGHJ6*01 | 2707 | O1_IGKJ1*01 | 832 | 1437 |
| 1069 | VH3-23_IGHD1-14*01>2'_IGHJ6*01 | 2708 | O1_IGKJ1*01 | 832 | 1437 |
| 1070 | VH3-23_IGHD1-14*01>3'_IGHJ6*01 | 2709 | O1_IGKJ1*01 | 832 | 1437 |
| 1071 | VH3-23_IGHD1-20*01>1'_IGHJ6*01 | 2710 | O1_IGKJ1*01 | 832 | 1437 |
| 1072 | VH3-23_IGHD1-20*01>2'_IGHJ6*01 | 2711 | O1_IGKJ1*01 | 832 | 1437 |
| 1073 | VH3-23_IGHD1-20*01>3'_IGHJ6*01 | 2712 | O1_IGKJ1*01 | 832 | 1437 |
| 1074 | VH3-23_IGHD1-26*01>1'_IGHJ6*01 | 2713 | O1_IGKJ1*01 | 832 | 1437 |
| 1075 | VH3-23_IGHD1-26*01>1_IGHJ6*01_B | 2714 | O1_IGKJ1*01 | 832 | 1437 |
| 1076 | VH3-23_IGHD2-2*01>2_IGHJ6*01_B | 2715 | O1_IGKJ1*01 | 832 | 1437 |
| 1077 | VH3-23_IGHD2-2*01>3'_IGHJ6*01 | 2716 | O1_IGKJ1*01 | 832 | 1437 |
| 1078 | VH3-23_IGHD2-8*01>1'_IGHJ6*01 | 2717 | O1_IGKJ1*01 | 832 | 1437 |
| 1079 | VH3-23_IGHD2-15*01>1'_IGHJ6*01 | 2718 | O1_IGKJ1*01 | 832 | 1437 |
| 1080 | VH3-23_IGHD2-15*01>3'_IGHJ6*01 | 2719 | O1_IGKJ1*01 | 832 | 1437 |
| 1081 | VH3-23_IGHD2-21*01>1'_IGHJ6*01 | 2720 | O1_IGKJ1*01 | 832 | 1437 |
| 1082 | VH3-23_IGHD2-21*01>3'_IGHJ6*01 | 2721 | O1_IGKJ1*01 | 832 | 1437 |
| 1083 | VH3-23_IGHD3-3*01>1'_IGHJ6*01 | 2722 | O1_IGKJ1*01 | 832 | 1437 |
| 1084 | VH3-23_IGHD3-3*01>3'_IGHJ6*01 | 2723 | O1_IGKJ1*01 | 832 | 1437 |
| 1085 | VH3-23_IGHD3-9*01>1'_IGHJ6*01 | 2724 | O1_IGKJ1*01 | 832 | 1437 |
| 1086 | VH3-23_IGHD3-9*01>3'_IGHJ6*01 | 2725 | O1_IGKJ1*01 | 832 | 1437 |
| 1087 | VH3-23_IGHD3-10*01>1'_IGHJ6*01 | 2726 | O1_IGKJ1*01 | 832 | 1437 |
| 1088 | VH3-23_IGHD3-10*01>3'_IGHJ6*01 | 2727 | O1_IGKJ1*01 | 832 | 1437 |
| 1089 | VH3-23_IGHD3-16*01>1'_IGHJ6*01 | 2728 | O1_IGKJ1*01 | 832 | 1437 |
| 1090 | VH3-23_IGHD3-16*01>3'_IGHJ6*01 | 2729 | O1_IGKJ1*01 | 832 | 1437 |
| 1091 | VH3-23_IGHD3-22*01>1'_IGHJ6*01 | 2730 | O1_IGKJ1*01 | 832 | 1437 |
| 1092 | VH3-23_IGHD4-4*01 (1) >1'_IGHJ6*01 | 2731 | O1_IGKJ1*01 | 832 | 1437 |
| 1093 | VH3-23_IGHD4-4*01 (1) >3'_IGHJ6*01 | 2732 | O1_IGKJ1*01 | 832 | 1437 |
| 1094 | VH3-23_IGHD4-11*01 (1) >1'_IGHJ6*01 | 2733 | O1_IGKJ1*01 | 832 | 1437 |
| 1095 | VH3-23_IGHD4-11*01 (1) >3'_IGHJ6*01 | 2734 | O1_IGKJ1*01 | 832 | 1437 |
| 1096 | VH3-23_IGHD4-17*01>1'_IGHJ6*01 | 2735 | O1_IGKJ1*01 | 832 | 1437 |
| 1097 | VH3-23_IGHD4-17*01>3'_IGHJ6*01 | 2736 | O1_IGKJ1*01 | 832 | 1437 |
| 1098 | VH3-23_IGHD4-23*01>1'_IGHJ6*01 | 2737 | O1_IGKJ1*01 | 832 | 1437 |
| 1099 | VH3-23_IGHD4-23*01>3'_IGHJ6*01 | 2738 | O1_IGKJ1*01 | 832 | 1437 |
| 1100 | VH3-23_IGHD5-5*01 (2) >1'_IGHJ6*01 | 2739 | O1_IGKJ1*01 | 832 | 1437 |
| 1101 | VH3-23_IGHD5-5*01 (2) >3'_IGHJ6*01 | 2740 | O1_IGKJ1*01 | 832 | 1437 |
| 1102 | VH3-23_IGHD5-12*01>1'_IGHJ6*01 | 2741 | O1_IGKJ1*01 | 832 | 1437 |
| 1103 | VH3-23_IGHD5-12*01>3'_IGHJ6*01 | 2742 | O1_IGKJ1*01 | 832 | 1437 |
| 1104 | VH3-23_IGHD5-18*01 (2) >1'_IGHJ6*01 | 2743 | O1_IGKJ1*01 | 832 | 1437 |
| 1105 | VH3-23_IGHD5-18*01 (2) >3'_IGHJ6*01 | 2744 | O1_IGKJ1*01 | 832 | 1437 |
| 1106 | VH3-23_IGHD5-24*01>1'_IGHJ6*01 | 2745 | O1_IGKJ1*01 | 832 | 1437 |
| 1107 | VH3-23_IGHD5-24*01>3'_IGHJ6*01 | 2746 | O1_IGKJ1*01 | 832 | 1437 |
| 1108 | VH3-23_IGHD6-6*01>1'_IGHJ6*01 | 2747 | O1_IGKJ1*01 | 832 | 1437 |
| 1109 | VH3-23_IGHD6-6*01>2'_IGHJ6*01 | 2748 | O1_IGKJ1*01 | 832 | 1437 |
| 1110 | VH3-23_IGHD6-6*01>3'_IGHJ6*01 | 2749 | O1_IGKJ1*01 | 832 | 1437 |
| 1111 | VH3-23_IGHD1-1*01>1_IGHJ5*01 | 2530 | A2_IGKJ1*01 | 808 | 1413 |
| 1112 | VH3-23_IGHD1-1*01>2_IGHJ5*01 | 2531 | A2_IGKJ1*01 | 808 | 1413 |
| 1113 | VH3-23_IGHD1-1*01>3_IGHJ5*01 | 2532 | A2_IGKJ1*01 | 808 | 1413 |
| 1114 | VH3-23_IGHD1-7*01>1_IGHJ5*01 | 2533 | A2_IGKJ1*01 | 808 | 1413 |
| 1115 | VH3-23_IGHD1-7*01>3_IGHJ5*01 | 2534 | A2_IGKJ1*01 | 808 | 1413 |
| 1116 | VH3-23_IGHD1-14*01>1_IGHJ5*01 | 2535 | A2_IGKJ1*01 | 808 | 1413 |
| 1117 | VH3-23_IGHD1-14*01>3_IGHJ5*01 | 2536 | A2_IGKJ1*01 | 808 | 1413 |
| 1118 | VH3-23_IGHD1-20*01>1_IGHJ5*01 | 2537 | A2_IGKJ1*01 | 808 | 1413 |
| 1119 | VH3-23_IGHD1-20*01>3_IGHJ5*01 | 2538 | A2_IGKJ1*01 | 808 | 1413 |
| 1120 | VH3-23_IGHD1-26*01>1_IGHJ5*01 | 2539 | A2_IGKJ1*01 | 808 | 1413 |
| 1121 | VH3-23_IGHD1-26*01>3_IGHJ5*01 | 2540 | A2_IGKJ1*01 | 808 | 1413 |
| 1122 | VH3-23_IGHD2-2*01>2_IGHJ5*01 | 2541 | A2_IGKJ1*01 | 808 | 1413 |
| 1123 | VH3-23_IGHD2-2*01>3_IGHJ5*01 | 2542 | A2_IGKJ1*01 | 808 | 1413 |
| 1124 | VH3-23_IGHD2-8*01>2_IGHJ5*01 | 2543 | A2_IGKJ1*01 | 808 | 1413 |
| 1125 | VH3-23_IGHD2-8*01>3_IGHJ5*01 | 2544 | A2_IGKJ1*01 | 808 | 1413 |
| 1126 | VH3-23_IGHD2-15*01>2_IGHJ5*01 | 2545 | A2_IGKJ1*01 | 808 | 1413 |
| 1127 | VH3-23_IGHD2-15*01>3_IGHJ5*01 | 2546 | A2_IGKJ1*01 | 808 | 1413 |
| 1128 | VH3-23_IGHD2-21*01>2_IGHJ5*01 | 2547 | A2_IGKJ1*01 | 808 | 1413 |
| 1129 | VH3-23_IGHD2-21*01>3_IGHJ5*01 | 2548 | A2_IGKJ1*01 | 808 | 1413 |
| 1130 | VH3-23_IGHD3-3*01>1_IGHJ5*01 | 2549 | A2_IGKJ1*01 | 808 | 1413 |
| 1131 | VH3-23_IGHD3-3*01>2_IGHJ5*01 | 2550 | A2_IGKJ1*01 | 808 | 1413 |
| 1132 | VH3-23_IGHD3-3*01>3_IGHJ5*01 | 2551 | A2_IGKJ1*01 | 808 | 1413 |
| 1133 | VH3-23_IGHD3-9*01>2_IGHJ5*01 | 2552 | A2_IGKJ1*01 | 808 | 1413 |
| 1134 | VH3-23_IGHD3-10*01>2_IGHJ5*01 | 2553 | A2_IGKJ1*01 | 808 | 1413 |
| 1135 | VH3-23_IGHD3-10*01>3_IGHJ5*01 | 2554 | A2_IGKJ1*01 | 808 | 1413 |
| 1136 | VH3-23_IGHD3-16*01>2_IGHJ5*01 | 2555 | A2_IGKJ1*01 | 808 | 1413 |
| 1137 | VH3-23_IGHD3-16*01>3_IGHJ5*01 | 2556 | A2_IGKJ1*01 | 808 | 1413 |
| 1138 | VH3-23_IGHD3-22*01>2_IGHJ5*01 | 2557 | A2_IGKJ1*01 | 808 | 1413 |
| 1139 | VH3-23_IGHD3-22*01>3_IGHJ5*01 | 2558 | A2_IGKJ1*01 | 808 | 1413 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 1140 | VH3-23_IGHD4-4*01 (1) >2_IGHJ5*01 | 2559 | A2_IGKJ1*01 | 808 | 1413 |
| 1141 | VH3-23_IGHD4-4*01 (1) >3_IGHJ5*01 | 2560 | A2_IGKJ1*01 | 808 | 1413 |
| 1142 | VH3-23_IGHD4-11*01 (1) >2_IGHJ5*01 | 2561 | A2_IGKJ1*01 | 808 | 1413 |
| 1143 | VH3-23_IGHD4-11*01 (1) >3_IGHJ5*01 | 2562 | A2_IGKJ1*01 | 808 | 1413 |
| 1144 | VH3-23_IGHD4-17*01>2_IGHJ5*01 | 2563 | A2_IGKJ1*01 | 808 | 1413 |
| 1145 | VH3-23_IGHD4-17*01>3_IGHJ5*01 | 2564 | A2_IGKJ1*01 | 808 | 1413 |
| 1146 | VH3-23_IGHD4-23*01>2_IGHJ5*01 | 2565 | A2_IGKJ1*01 | 808 | 1413 |
| 1147 | VH3-23_IGHD4-23*01>3_IGHJ5*01 | 2566 | A2_IGKJ1*01 | 808 | 1413 |
| 1148 | VH3-23_IGHD5-5*01 (2) >1_IGHJ5*01 | 2567 | A2_IGKJ1*01 | 808 | 1413 |
| 1149 | VH3-23_IGHD5-5*01 (2) >2_IGHJ5*01 | 2568 | A2_IGKJ1*01 | 808 | 1413 |
| 1150 | VH3-23_IGHD5-5*01 (2) >3_IGHJ5*01 | 2569 | A2_IGKJ1*01 | 808 | 1413 |
| 1151 | VH3-23_IGHD5-12*01>1_IGHJ5*01 | 2570 | A2_IGKJ1*01 | 808 | 1413 |
| 1152 | VH3-23_IGHD5-12*01>3_IGHJ5*01 | 2571 | A2_IGKJ1*01 | 808 | 1413 |
| 1153 | VH3-23_IGHD5-18*01 (2) >1_IGHJ5*01 | 2572 | A2_IGKJ1*01 | 808 | 1413 |
| 1154 | VH3-23_IGHD5-18*01 (2) >2_IGHJ5*01 | 2573 | A2_IGKJ1*01 | 808 | 1413 |
| 1155 | VH3-23_IGHD5-18*01 (2) >3_IGHJ5*01 | 2574 | A2_IGKJ1*01 | 808 | 1413 |
| 1156 | VH3-23_IGHD5-24*01>1_IGHJ5*01 | 2575 | A2_IGKJ1*01 | 808 | 1413 |
| 1157 | VH3-23_IGHD5-24*01>3_IGHJ5*01 | 2576 | A2_IGKJ1*01 | 808 | 1413 |
| 1158 | VH3-23_IGHD6-6*01>1_IGHJ5*01 | 2577 | A2_IGKJ1*01 | 808 | 1413 |
| 1159 | VH3-23_IGHD1-1*01>1'_IGHJ5*01 | 2587 | A2_IGKJ1*01 | 808 | 1413 |
| 1160 | VH3-23_IGHD1-1*01>2'_IGHJ5*01 | 2588 | A2_IGKJ1*01 | 808 | 1413 |
| 1161 | VH3-23_IGHD1-1*01>3'_IGHJ5*01 | 2589 | A2_IGKJ1*01 | 808 | 1413 |
| 1162 | VH3-23_IGHD1-7*01>1'_IGHJ5*01 | 2590 | A2_IGKJ1*01 | 808 | 1413 |
| 1163 | VH3-23_IGHD1-7*01>3'_IGHJ5*01 | 2591 | A2_IGKJ1*01 | 808 | 1413 |
| 1164 | VH3-23_IGHD1-14*01>1'_IGHJ5*01 | 2592 | A2_IGKJ1*01 | 808 | 1413 |
| 1165 | VH3-23_IGHD1-14*01>2'_IGHJ5*01 | 2593 | A2_IGKJ1*01 | 808 | 1413 |
| 1166 | VH3-23_IGHD1-14*01>3'_IGHJ5*01 | 2594 | A2_IGKJ1*01 | 808 | 1413 |
| 1167 | VH3-23_IGHD1-20*01>1'_IGHJ5*01 | 2595 | A2_IGKJ1*01 | 808 | 1413 |
| 1168 | VH3-23_IGHD1-20*01>2'_IGHJ5*01 | 2596 | A2_IGKJ1*01 | 808 | 1413 |
| 1169 | VH3-23_IGHD1-20*01>3'_IGHJ5*01 | 2597 | A2_IGKJ1*01 | 808 | 1413 |
| 1170 | VH3-23_IGHD1-26*01>1'_IGHJ5*01 | 2598 | A2_IGKJ1*01 | 808 | 1413 |
| 1171 | VH3-23_IGHD1-26*01>3'_IGHJ5*01 | 2599 | A2_IGKJ1*01 | 808 | 1413 |
| 1172 | VH3-23_IGHD2-2*01>1'_IGHJ5*01 | 2600 | A2_IGKJ1*01 | 808 | 1413 |
| 1173 | VH3-23_IGHD2-2*01>3'_IGHJ5*01 | 2601 | A2_IGKJ1*01 | 808 | 1413 |
| 1174 | VH3-23_IGHD2-8*01>1'_IGHJ5*01 | 2602 | A2_IGKJ1*01 | 808 | 1413 |
| 1175 | VH3-23_IGHD2-15*01>1'_IGHJ5*01 | 2603 | A2_IGKJ1*01 | 808 | 1413 |
| 1176 | VH3-23_IGHD2-15*01>3'_IGHJ5*01 | 2604 | A2_IGKJ1*01 | 808 | 1413 |
| 1177 | VH3-23_IGHD2-21*01>1'_IGHJ5*01 | 2605 | A2_IGKJ1*01 | 808 | 1413 |
| 1178 | VH3-23_IGHD2-21*01>3'_IGHJ5*01 | 2606 | A2_IGKJ1*01 | 808 | 1413 |
| 1179 | VH3-23_IGHD3-3*01>1'_IGHJ5*01 | 2607 | A2_IGKJ1*01 | 808 | 1413 |
| 1180 | VH3-23_IGHD3-3*01>3'_IGHJ5*01 | 2608 | A2_IGKJ1*01 | 808 | 1413 |
| 1181 | VH3-23_IGHD3-9*01>1'_IGHJ5*01 | 2609 | A2_IGKJ1*01 | 808 | 1413 |
| 1182 | VH3-23_IGHD3-9*01>3'_IGHJ5*01 | 2610 | A2_IGKJ1*01 | 808 | 1413 |
| 1183 | VH3-23_IGHD3-10*01>1'_IGHJ5*01 | 2611 | A2_IGKJ1*01 | 808 | 1413 |
| 1184 | VH3-23_IGHD3-10*01>3'_IGHJ5*01 | 2612 | A2_IGKJ1*01 | 808 | 1413 |
| 1185 | VH3-23_IGHD3-16*01>1'_IGHJ5*01 | 2613 | A2_IGKJ1*01 | 808 | 1413 |
| 1186 | VH3-23_IGHD3-16*01>3'_IGHJ5*01 | 2614 | A2_IGKJ1*01 | 808 | 1413 |
| 1187 | VH3-23_IGHD3-22*01>1'_IGHJ5*01 | 2615 | A2_IGKJ1*01 | 808 | 1413 |
| 1188 | VH3-23_IGHD4-4*01 (1) >1'_IGHJ5*01 | 2616 | A2_IGKJ1*01 | 808 | 1413 |
| 1189 | VH3-23_IGHD4-4*01 (1) >3'_IGHJ5*01 | 2617 | A2_IGKJ1*01 | 808 | 1413 |
| 1190 | VH3-23_IGHD4-11*01 (1) >1'_IGHJ5*01 | 2618 | A2_IGKJ1*01 | 808 | 1413 |
| 1191 | VH3-23_IGHD4-11*01 (1) >3'_IGHJ5*01 | 2619 | A2_IGKJ1*01 | 808 | 1413 |
| 1192 | VH3-23_IGHD4-17*01>1'_IGHJ5*01 | 2620 | A2_IGKJ1*01 | 808 | 1413 |
| 1193 | VH3-23_IGHD4-17*01>3'_IGHJ5*01 | 2621 | A2_IGKJ1*01 | 808 | 1413 |
| 1194 | VH3-23_IGHD4-23*01>1'_IGHJ5*01 | 2622 | A2_IGKJ1*01 | 808 | 1413 |
| 1195 | VH3-23_IGHD4-23*01>3'_IGHJ5*01 | 2623 | A2_IGKJ1*01 | 808 | 1413 |
| 1196 | VH3-23_IGHD5-5*01 (2) >1'_IGHJ5*01 | 2624 | A2_IGKJ1*01 | 808 | 1413 |
| 1197 | VH3-23_IGHD5-5*01 (2) >3'_IGHJ5*01 | 2625 | A2_IGKJ1*01 | 808 | 1413 |
| 1198 | VH3-23_IGHD5-12*01>1'_IGHJ5*01 | 2626 | A2_IGKJ1*01 | 808 | 1413 |
| 1199 | VH3-23_IGHD5-12*01>3'_IGHJ5*01 | 2627 | A2_IGKJ1*01 | 808 | 1413 |
| 1200 | VH3-23_IGHD5-18*01 (2) >1'_IGHJ5*01 | 2628 | A2_IGKJ1*01 | 808 | 1413 |
| 1201 | VH3-23_IGHD5-18*01 (2) >3'_IGHJ5*01 | 2629 | A2_IGKJ1*01 | 808 | 1413 |
| 1202 | VH3-23_IGHD5-24*01>1'_IGHJ5*01 | 2630 | A2_IGKJ1*01 | 808 | 1413 |
| 1203 | VH3-23_IGHD5-24*01>3'_IGHJ5*01 | 2631 | A2_IGKJ1*01 | 808 | 1413 |
| 1204 | VH3-23_IGHD6-6*01>1'_IGHJ5*01 | 2632 | A2_IGKJ1*01 | 808 | 1413 |
| 1205 | VH3-23_IGHD6-6*01>2'_IGHJ5*01 | 2633 | A2_IGKJ1*01 | 808 | 1413 |
| 1206 | VH3-23_IGHD6-6*01>3'_IGHJ5*01 | 2634 | A2_IGKJ1*01 | 808 | 1413 |
| 1207 | VH3-23_IGHD1-1*01>1_IGHJ6*01 | 2645 | L2_IGKJ1*01 | 822 | 1427 |
| 1208 | VH3-23_IGHD1-1*01>2_IGHJ6*01 | 2646 | L2_IGKJ1*01 | 822 | 1427 |
| 1209 | VH3-23_IGHD1-1*01>3_IGHJ6*01 | 2647 | L2_IGKJ1*01 | 822 | 1427 |
| 1210 | VH3-23_IGHD1-7*01>1_IGHJ6*01 | 2648 | L2_IGKJ1*01 | 822 | 1427 |
| 1211 | VH3-23_IGHD1-7*01>3_IGHJ6*01 | 2649 | L2_IGKJ1*01 | 822 | 1427 |
| 1212 | VH3-23_IGHD1-14*01>1_IGHJ6*01 | 2650 | L2_IGKJ1*01 | 822 | 1427 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 1213 | VH3-23_IGHD1-14*01>3_IGHJ6*01 | 2651 | L2_IGKJ1*01 | 822 | 1427 |
| 1214 | VH3-23_IGHD1-20*01>1_IGHJ6*01 | 2652 | L2_IGKJ1*01 | 822 | 1427 |
| 1215 | VH3-23_IGHD1-20*01>3_IGHJ6*01 | 2653 | L2_IGKJ1*01 | 822 | 1427 |
| 1216 | VH3-23_IGHD1-26*01>1_IGHJ6*01 | 2654 | L2_IGKJ1*01 | 822 | 1427 |
| 1217 | VH3-23_IGHD1-26*01>3_IGHJ6*01 | 2655 | L2_IGKJ1*01 | 822 | 1427 |
| 1218 | VH3-23_IGHD2-2*01>2_IGHJ6*01 | 2656 | L2_IGKJ1*01 | 822 | 1427 |
| 1219 | VH3-23_IGHD2-2*01>3_IGHJ6*01 | 2657 | L2_IGKJ1*01 | 822 | 1427 |
| 1220 | VH3-23_IGHD2-8*01>2_IGHJ6*01 | 2658 | L2_IGKJ1*01 | 822 | 1427 |
| 1221 | VH3-23_IGHD2-8*01>3_IGHJ6*01 | 2659 | L2_IGKJ1*01 | 822 | 1427 |
| 1222 | VH3-23_IGHD2-15*01>2_IGHJ6*01 | 2660 | L2_IGKJ1*01 | 822 | 1427 |
| 1223 | VH3-23_IGHD2-15*01>3_IGHJ6*01 | 2661 | L2_IGKJ1*01 | 822 | 1427 |
| 1224 | VH3-23_IGHD2-21*01>2_IGHJ6*01 | 2662 | L2_IGKJ1*01 | 822 | 1427 |
| 1225 | VH3-23_IGHD2-21*01>3_IGHJ6*01 | 2663 | L2_IGKJ1*01 | 822 | 1427 |
| 1226 | VH3-23_IGHD3-3*01>1_IGHJ6*01 | 2664 | L2_IGKJ1*01 | 822 | 1427 |
| 1227 | VH3-23_IGHD3-3*01>2_IGHJ6*01 | 2665 | L2_IGKJ1*01 | 822 | 1427 |
| 1228 | VH3-23_IGHD3-3*01>3_IGHJ6*01 | 2666 | L2_IGKJ1*01 | 822 | 1427 |
| 1229 | VH3-23_IGHD3-9*01>2_IGHJ6*01 | 2667 | L2_IGKJ1*01 | 822 | 1427 |
| 1230 | VH3-23_IGHD3-10*01>2_IGHJ6*01 | 2668 | L2_IGKJ1*01 | 822 | 1427 |
| 1231 | VH3-23_IGHD3-10*01>3_IGHJ6*01 | 2669 | L2_IGKJ1*01 | 822 | 1427 |
| 1232 | VH3-23_IGHD3-16*01>2_IGHJ6*01 | 2670 | L2_IGKJ1*01 | 822 | 1427 |
| 1233 | VH3-23_IGHD3-16*01>3_IGHJ6*01 | 2671 | L2_IGKJ1*01 | 822 | 1427 |
| 1234 | VH3-23_IGHD3-22*01>2_IGHJ6*01 | 2672 | L2_IGKJ1*01 | 822 | 1427 |
| 1235 | VH3-23_IGHD3-22*01>3_IGHJ6*01 | 2673 | L2_IGKJ1*01 | 822 | 1427 |
| 1236 | VH3-23_IGHD4-4*01 (1) >2_IGHJ6*01 | 2674 | L2_IGKJ1*01 | 822 | 1427 |
| 1237 | VH3-23_IGHD4-4*01 (1) >3_IGHJ6*01 | 2675 | L2_IGKJ1*01 | 822 | 1427 |
| 1238 | VH3-23_IGHD4-11*01 (1) >2_IGHJ6*01 | 2676 | L2_IGKJ1*01 | 822 | 1427 |
| 1239 | VH3-23_IGHD4-11*01 (1) >3_IGHJ6*01 | 2677 | L2_IGKJ1*01 | 822 | 1427 |
| 1240 | VH3-23_IGHD4-17*01>2_IGHJ6*01 | 2678 | L2_IGKJ1*01 | 822 | 1427 |
| 1241 | VH3-23_IGHD4-17*01>3_IGHJ6*01 | 2679 | L2_IGKJ1*01 | 822 | 1427 |
| 1242 | VH3-23_IGHD4-23*01>2_IGHJ6*01 | 2680 | L2_IGKJ1*01 | 822 | 1427 |
| 1243 | VH3-23_IGHD4-23*01>3_IGHJ6*01 | 2681 | L2_IGKJ1*01 | 822 | 1427 |
| 1244 | VH3-23_IGHD5-5*01 (2) >1_IGHJ6*01 | 2682 | L2_IGKJ1*01 | 822 | 1427 |
| 1245 | VH3-23_IGHD5-5*01 (2) >2_IGHJ6*01 | 2683 | L2_IGKJ1*01 | 822 | 1427 |
| 1246 | VH3-23_IGHD5-5*01 (2) >3_IGHJ6*01 | 2684 | L2_IGKJ1*01 | 822 | 1427 |
| 1247 | VH3-23_IGHD5-12*01>1_IGHJ6*01 | 2685 | L2_IGKJ1*01 | 822 | 1427 |
| 1248 | VH3-23_IGHD5-12*01>3_IGHJ6*01 | 2686 | L2_IGKJ1*01 | 822 | 1427 |
| 1249 | VH3-23_IGHD5-18*01 (2) >1_IGHJ6*01 | 2687 | L2_IGKJ1*01 | 822 | 1427 |
| 1250 | VH3-23_IGHD5-18*01 (2) >2_IGHJ6*01 | 2688 | L2_IGKJ1*01 | 822 | 1427 |
| 1251 | VH3-23_IGHD5-18*01 (2) >3_IGHJ6*01 | 2689 | L2_IGKJ1*01 | 822 | 1427 |
| 1252 | VH3-23_IGHD5-24*01>1_IGHJ6*01 | 2690 | L2_IGKJ1*01 | 822 | 1427 |
| 1253 | VH3-23_IGHD5-24*01>3_IGHJ6*01 | 2691 | L2_IGKJ1*01 | 822 | 1427 |
| 1254 | VH3-23_IGHD6-6*01>1_IGHJ6*01 | 2692 | L2_IGKJ1*01 | 822 | 1427 |
| 1255 | VH3-23_IGHD1-1*01>1'_IGHJ6*01 | 2702 | L2_IGKJ1*01 | 822 | 1427 |
| 1256 | VH3-23_IGHD1-1*01>2'_IGHJ6*01 | 2703 | L2_IGKJ1*01 | 822 | 1427 |
| 1257 | VH3-23_IGHD1-1*01>3'_IGHJ6*01 | 2704 | L2_IGKJ1*01 | 822 | 1427 |
| 1258 | VH3-23_IGHD1-7*01>1'_IGHJ6*01 | 2705 | L2_IGKJ1*01 | 822 | 1427 |
| 1259 | VH3-23_IGHD1-7*01>3'_IGHJ6*01 | 2706 | L2_IGKJ1*01 | 822 | 1427 |
| 1260 | VH3-23_IGHD1-14*01>1'_IGHJ6*01 | 2707 | L2_IGKJ1*01 | 822 | 1427 |
| 1261 | VH3-23_IGHD1-14*01>2'_IGHJ6*01 | 2708 | L2_IGKJ1*01 | 822 | 1427 |
| 1262 | VH3-23_IGHD1-14*01>3'_IGHJ6*01 | 2709 | L2_IGKJ1*01 | 822 | 1427 |
| 1263 | VH3-23_IGHD1-20*01>1'_IGHJ6*01 | 2710 | L2_IGKJ1*01 | 822 | 1427 |
| 1264 | VH3-23_IGHD1-20*01>2'_IGHJ6*01 | 2711 | L2_IGKJ1*01 | 822 | 1427 |
| 1265 | VH3-23_IGHD1-20*01>3'_IGHJ6*01 | 2712 | L2_IGKJ1*01 | 822 | 1427 |
| 1266 | VH3-23_IGHD1-26*01>1'_IGHJ6*01 | 2713 | L2_IGKJ1*01 | 822 | 1427 |
| 1267 | VH3-23_IGHD1-26*01>1'_IGHJ6*01_B | 2714 | L2_IGKJ1*01 | 822 | 1427 |
| 1268 | VH3-23_IGHD2-2*01>2_IGHJ6*01_B | 2715 | L2_IGKJ1*01 | 822 | 1427 |
| 1269 | VH3-23_IGHD2-2*01>3'_IGHJ6*01 | 2716 | L2_IGKJ1*01 | 822 | 1427 |
| 1270 | VH3-23_IGHD2-8*01>1'_IGHJ6*01 | 2717 | L2_IGKJ1*01 | 822 | 1427 |
| 1271 | VH3-23_IGHD2-15*01>1'_IGHJ6*01 | 2718 | L2_IGKJ1*01 | 822 | 1427 |
| 1272 | VH3-23_IGHD2-15*01>3'_IGHJ6*01 | 2719 | L2_IGKJ1*01 | 822 | 1427 |
| 1273 | VH3-23_IGHD2-21*01>1'_IGHJ6*01 | 2720 | L2_IGKJ1*01 | 822 | 1427 |
| 1274 | VH3-23_IGHD2-21*01>3'_IGHJ6*01 | 2721 | L2_IGKJ1*01 | 822 | 1427 |
| 1275 | VH3-23_IGHD3-3*01>1'_IGHJ6*01 | 2722 | L2_IGKJ1*01 | 822 | 1427 |
| 1276 | VH3-23_IGHD3-3*01>3'_IGHJ6*01 | 2723 | L2_IGKJ1*01 | 822 | 1427 |
| 1277 | VH3-23_IGHD3-9*01>1'_IGHJ6*01 | 2724 | L2_IGKJ1*01 | 822 | 1427 |
| 1278 | VH3-23_IGHD3-9*01>3'_IGHJ6*01 | 2725 | L2_IGKJ1*01 | 822 | 1427 |
| 1279 | VH3-23_IGHD3-10*01>1'_IGHJ6*01 | 2726 | L2_IGKJ1*01 | 822 | 1427 |
| 1280 | VH3-23_IGHD3-10*01>3'_IGHJ6*01 | 2727 | L2_IGKJ1*01 | 822 | 1427 |
| 1281 | VH3-23_IGHD3-16*01>1'_IGHJ6*01 | 2728 | L2_IGKJ1*01 | 822 | 1427 |
| 1282 | VH3-23_IGHD3-16*01>3'_IGHJ6*01 | 2729 | L2_IGKJ1*01 | 822 | 1427 |
| 1283 | VH3-23_IGHD3-22*01>1'_IGHJ6*01 | 2730 | L2_IGKJ1*01 | 822 | 1427 |
| 1284 | VH3-23_IGHD4-4*01 (1) >1'_IGHJ6*01 | 2731 | L2_IGKJ1*01 | 822 | 1427 |
| 1285 | VH3-23_IGHD4-4*01 (1) >3'_IGHJ6*01 | 2732 | L2_IGKJ1*01 | 822 | 1427 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 1286 | VH3-23__IGHD4-11*01 (1) >1'__IGHJ6*01 | 2733 | L2_IGKJ1*01 | 822 | 1427 |
| 1287 | VH3-23__IGHD4-11*01 (1) >3'__IGHJ6*01 | 2734 | L2_IGKJ1*01 | 822 | 1427 |
| 1288 | VH3-23__IGHD4-17*01>1'__IGHJ6*01 | 2735 | L2_IGKJ1*01 | 822 | 1427 |
| 1289 | VH3-23__IGHD4-17*01>3'__IGHJ6*01 | 2736 | L2_IGKJ1*01 | 822 | 1427 |
| 1290 | VH3-23__IGHD4-23*01>1'__IGHJ6*01 | 2737 | L2_IGKJ1*01 | 822 | 1427 |
| 1291 | VH3-23__IGHD4-23*01>3'__IGHJ6*01 | 2738 | L2_IGKJ1*01 | 822 | 1427 |
| 1292 | VH3-23__IGHD5-5*01 (2) >1'__IGHJ6*01 | 2739 | L2_IGKJ1*01 | 822 | 1427 |
| 1293 | VH3-23__IGHD5-5*01 (2) >3'__IGHJ6*01 | 2740 | L2_IGKJ1*01 | 822 | 1427 |
| 1294 | VH3-23__IGHD5-12*01>1'__IGHJ6*01 | 2741 | L2_IGKJ1*01 | 822 | 1427 |
| 1295 | VH3-23__IGHD5-12*01>3'__IGHJ6*01 | 2742 | L2_IGKJ1*01 | 822 | 1427 |
| 1296 | VH3-23__IGHD5-18*01 (2) >1'__IGHJ6*01 | 2743 | L2_IGKJ1*01 | 822 | 1427 |
| 1297 | VH3-23__IGHD5-18*01 (2) >3'__IGHJ6*01 | 2744 | L2_IGKJ1*01 | 822 | 1427 |
| 1298 | VH3-23__IGHD5-24*01>1'__IGHJ6*01 | 2745 | L2_IGKJ1*01 | 822 | 1427 |
| 1299 | VH3-23__IGHD5-24*01>3'__IGHJ6*01 | 2746 | L2_IGKJ1*01 | 822 | 1427 |
| 1300 | VH3-23__IGHD6-6*01>1'__IGHJ6*01 | 2747 | L2_IGKJ1*01 | 822 | 1427 |
| 1301 | VH3-23__IGHD6-6*01>2'__IGHJ6*01 | 2748 | L2_IGKJ1*01 | 822 | 1427 |
| 1302 | VH3-23__IGHD6-6*01>3'__IGHJ6*01 | 2749 | L2_IGKJ1*01 | 822 | 1427 |
| 1303 | VH3-23__IGHD1-1*01>1__IGHJ6*01 | 2645 | L6_IGKJ1*01 | 829 | 1434 |
| 1304 | VH3-23__IGHD1-1*01>2__IGHJ6*01 | 2646 | L6_IGKJ1*01 | 829 | 1434 |
| 1305 | VH3-23__IGHD1-1*01>3__IGHJ6*01 | 2647 | L6_IGKJ1*01 | 829 | 1434 |
| 1306 | VH3-23__IGHD1-7*01>1__IGHJ6*01 | 2648 | L6_IGKJ1*01 | 829 | 1434 |
| 1307 | VH3-23__IGHD1-7*01>3__IGHJ6*01 | 2649 | L6_IGKJ1*01 | 829 | 1434 |
| 1308 | VH3-23__IGHD1-14*01>1__IGHJ6*01 | 2650 | L6_IGKJ1*01 | 829 | 1434 |
| 1309 | VH3-23__IGHD1-14*01>3__IGHJ6*01 | 2651 | L6_IGKJ1*01 | 829 | 1434 |
| 1310 | VH3-23__IGHD1-20*01>1__IGHJ6*01 | 2652 | L6_IGKJ1*01 | 829 | 1434 |
| 1311 | VH3-23__IGHD1-20*01>3__IGHJ6*01 | 2653 | L6_IGKJ1*01 | 829 | 1434 |
| 1312 | VH3-23__IGHD1-26*01>1__IGHJ6*01 | 2654 | L6_IGKJ1*01 | 829 | 1434 |
| 1313 | VH3-23__IGHD1-26*01>3__IGHJ6*01 | 2655 | L6_IGKJ1*01 | 829 | 1434 |
| 1314 | VH3-23__IGHD2-2*01>2__IGHJ6*01 | 2656 | L6_IGKJ1*01 | 829 | 1434 |
| 1315 | VH3-23__IGHD2-2*01>3__IGHJ6*01 | 2657 | L6_IGKJ1*01 | 829 | 1434 |
| 1316 | VH3-23__IGHD2-8*01>2__IGHJ6*01 | 2658 | L6_IGKJ1*01 | 829 | 1434 |
| 1317 | VH3-23__IGHD2-8*01>3__IGHJ6*01 | 2659 | L6_IGKJ1*01 | 829 | 1434 |
| 1318 | VH3-23__IGHD2-15*01>2__IGHJ6*01 | 2660 | L6_IGKJ1*01 | 829 | 1434 |
| 1319 | VH3-23__IGHD2-15*01>3__IGHJ6*01 | 2661 | L6_IGKJ1*01 | 829 | 1434 |
| 1320 | VH3-23__IGHD2-21*01>2__IGHJ6*01 | 2662 | L6_IGKJ1*01 | 829 | 1434 |
| 1321 | VH3-23__IGHD2-21*01>3__IGHJ6*01 | 2663 | L6_IGKJ1*01 | 829 | 1434 |
| 1322 | VH3-23__IGHD3-3*01>1__IGHJ6*01 | 2664 | L6_IGKJ1*01 | 829 | 1434 |
| 1323 | VH3-23__IGHD3-3*01>2__IGHJ6*01 | 2665 | L6_IGKJ1*01 | 829 | 1434 |
| 1324 | VH3-23__IGHD3-3*01>3__IGHJ6*01 | 2666 | L6_IGKJ1*01 | 829 | 1434 |
| 1325 | VH3-23__IGHD3-9*01>2__IGHJ6*01 | 2667 | L6_IGKJ1*01 | 829 | 1434 |
| 1326 | VH3-23__IGHD3-10*01>2__IGHJ6*01 | 2668 | L6_IGKJ1*01 | 829 | 1434 |
| 1327 | VH3-23__IGHD3-10*01>3__IGHJ6*01 | 2669 | L6_IGKJ1*01 | 829 | 1434 |
| 1328 | VH3-23__IGHD3-16*01>2__IGHJ6*01 | 2670 | L6_IGKJ1*01 | 829 | 1434 |
| 1329 | VH3-23__IGHD3-16*01>3__IGHJ6*01 | 2671 | L6_IGKJ1*01 | 829 | 1434 |
| 1330 | VH3-23__IGHD3-22*01>2__IGHJ6*01 | 2672 | L6_IGKJ1*01 | 829 | 1434 |
| 1331 | VH3-23__IGHD3-22*01>3__IGHJ6*01 | 2673 | L6_IGKJ1*01 | 829 | 1434 |
| 1332 | VH3-23__IGHD4-4*01 (1) >2__IGHJ6*01 | 2674 | L6_IGKJ1*01 | 829 | 1434 |
| 1333 | VH3-23__IGHD4-4*01 (1) >3__IGHJ6*01 | 2675 | L6_IGKJ1*01 | 829 | 1434 |
| 1334 | VH3-23__IGHD4-11*01 (1) >2__IGHJ6*01 | 2676 | L6_IGKJ1*01 | 829 | 1434 |
| 1335 | VH3-23__IGHD4-11*01 (1) >3__IGHJ6*01 | 2677 | L6_IGKJ1*01 | 829 | 1434 |
| 1336 | VH3-23__IGHD4-17*01>2__IGHJ6*01 | 2678 | L6_IGKJ1*01 | 829 | 1434 |
| 1337 | VH3-23__IGHD4-17*01>3__IGHJ6*01 | 2679 | L6_IGKJ1*01 | 829 | 1434 |
| 1338 | VH3-23__IGHD4-23*01>2__IGHJ6*01 | 2680 | L6_IGKJ1*01 | 829 | 1434 |
| 1339 | VH3-23__IGHD4-23*01>3__IGHJ6*01 | 2681 | L6_IGKJ1*01 | 829 | 1434 |
| 1340 | VH3-23__IGHD5-5*01 (2) >1__IGHJ6*01 | 2682 | L6_IGKJ1*01 | 829 | 1434 |
| 1341 | VH3-23__IGHD5-5*01 (2) >2__IGHJ6*01 | 2683 | L6_IGKJ1*01 | 829 | 1434 |
| 1342 | VH3-23__IGHD5-5*01 (2) >3__IGHJ6*01 | 2684 | L6_IGKJ1*01 | 829 | 1434 |
| 1343 | VH3-23__IGHD5-12*01>1__IGHJ6*01 | 2685 | L6_IGKJ1*01 | 829 | 1434 |
| 1344 | VH3-23__IGHD5-12*01>3__IGHJ6*01 | 2686 | L6_IGKJ1*01 | 829 | 1434 |
| 1345 | VH3-23__IGHD5-18*01 (2) >1__IGHJ6*01 | 2687 | L6_IGKJ1*01 | 829 | 1434 |
| 1346 | VH3-23__IGHD5-18*01 (2) >2__IGHJ6*01 | 2688 | L6_IGKJ1*01 | 829 | 1434 |
| 1347 | VH3-23__IGHD5-18*01 (2) >3__IGHJ6*01 | 2689 | L6_IGKJ1*01 | 829 | 1434 |
| 1348 | VH3-23__IGHD5-24*01>1__IGHJ6*01 | 2690 | L6_IGKJ1*01 | 829 | 1434 |
| 1349 | VH3-23__IGHD5-24*01>3__IGHJ6*01 | 2691 | L6_IGKJ1*01 | 829 | 1434 |
| 1350 | VH3-23__IGHD6-6*01>1__IGHJ6*01 | 2692 | L6_IGKJ1*01 | 829 | 1434 |
| 1351 | VH3-23__IGHD1-1*01>1'__IGHJ6*01 | 2702 | L6_IGKJ1*01 | 829 | 1434 |
| 1352 | VH3-23__IGHD1-1*01>2'__IGHJ6*01 | 2703 | L6_IGKJ1*01 | 829 | 1434 |
| 1353 | VH3-23__IGHD1-1*01>3'__IGHJ6*01 | 2704 | L6_IGKJ1*01 | 829 | 1434 |
| 1354 | VH3-23__IGHD1-7*01>1'__IGHJ6*01 | 2705 | L6_IGKJ1*01 | 829 | 1434 |
| 1355 | VH3-23__IGHD1-7*01>3'__IGHJ6*01 | 2706 | L6_IGKJ1*01 | 829 | 1434 |
| 1356 | VH3-23__IGHD1-14*01>1'__IGHJ6*01 | 2707 | L6_IGKJ1*01 | 829 | 1434 |
| 1357 | VH3-23__IGHD1-14*01>2'__IGHJ6*01 | 2708 | L6_IGKJ1*01 | 829 | 1434 |
| 1358 | VH3-23__IGHD1-14*01>3'__IGHJ6*01 | 2709 | L6_IGKJ1*01 | 829 | 1434 |

TABLE 17A-continued

Exemplary Nucleic Acid Paired Library

| HEAVY CHAIN Name | RS SEQ ID NO | LIGHT CHAIN Name | RS SEQ ID NO | NO RS SEQ ID NO |
|---|---|---|---|---|
| 1359 VH3-23_IGHD1-20*01>1'_IGHJ6*01 | 2710 | L6_IGKJ1*01 | 829 | 1434 |
| 1360 VH3-23_IGHD1-20*01>2'_IGHJ6*01 | 2711 | L6_IGKJ1*01 | 829 | 1434 |
| 1361 VH3-23_IGHD1-20*01>3'_IGHJ6*01 | 2712 | L6_IGKJ1*01 | 829 | 1434 |
| 1362 VH3-23_IGHD1-26*01>1'_IGHJ6*01 | 2713 | L6_IGKJ1*01 | 829 | 1434 |
| 1363 VH3-23_IGHD1-26*01>1_IGHJ6*01_B | 2714 | L6_IGKJ1*01 | 829 | 1434 |
| 1364 VH3-23_IGHD2-2*01>2_IGHJ6*01_B | 2715 | L6_IGKJ1*01 | 829 | 1434 |
| 1365 VH3-23_IGHD2-2*01>3'_IGHJ6*01 | 2716 | L6_IGKJ1*01 | 829 | 1434 |
| 1366 VH3-23_IGHD2-8*01>1'_IGHJ6*01 | 2717 | L6_IGKJ1*01 | 829 | 1434 |
| 1367 VH3-23_IGHD2-15*01>1'_IGHJ6*01 | 2718 | L6_IGKJ1*01 | 829 | 1434 |
| 1368 VH3-23_IGHD2-15*01>3'_IGHJ6*01 | 2719 | L6_IGKJ1*01 | 829 | 1434 |
| 1369 VH3-23_IGHD2-21*01>1'_IGHJ6*01 | 2720 | L6_IGKJ1*01 | 829 | 1434 |
| 1370 VH3-23_IGHD2-21*01>3'_IGHJ6*01 | 2721 | L6_IGKJ1*01 | 829 | 1434 |
| 1371 VH3-23_IGHD3-3*01>1'_IGHJ6*01 | 2722 | L6_IGKJ1*01 | 829 | 1434 |
| 1372 VH3-23_IGHD3-3*01>3'_IGHJ6*01 | 2723 | L6_IGKJ1*01 | 829 | 1434 |
| 1373 VH3-23_IGHD3-9*01>1'_IGHJ6*01 | 2724 | L6_IGKJ1*01 | 829 | 1434 |
| 1374 VH3-23_IGHD3-9*01>3'_IGHJ6*01 | 2725 | L6_IGKJ1*01 | 829 | 1434 |
| 1375 VH3-23_IGHD3-10*01>1'_IGHJ6*01 | 2726 | L6_IGKJ1*01 | 829 | 1434 |
| 1376 VH3-23_IGHD3-10*01>3'_IGHJ6*01 | 2727 | L6_IGKJ1*01 | 829 | 1434 |
| 1377 VH3-23_IGHD3-16*01>1'_IGHJ6*01 | 2728 | L6_IGKJ1*01 | 829 | 1434 |
| 1378 VH3-23_IGHD3-16*01>3'_IGHJ6*01 | 2729 | L6_IGKJ1*01 | 829 | 1434 |
| 1379 VH3-23_IGHD3-22*01>1'_IGHJ6*01 | 2730 | L6_IGKJ1*01 | 829 | 1434 |
| 1380 VH3-23_IGHD4-4*01 (1) >1'_IGHJ6*01 | 2731 | L6_IGKJ1*01 | 829 | 1434 |
| 1381 VH3-23_IGHD4-4*01 (1) >3'_IGHJ6*01 | 2732 | L6_IGKJ1*01 | 829 | 1434 |
| 1382 VH3-23_IGHD4-11*01 (1) >1'_IGHJ6*01 | 2733 | L6_IGKJ1*01 | 829 | 1434 |
| 1383 VH3-23_IGHD4-11*01 (1) >3'_IGHJ6*01 | 2734 | L6_IGKJ1*01 | 829 | 1434 |
| 1384 VH3-23_IGHD4-17*01>1'_IGHJ6*01 | 2735 | L6_IGKJ1*01 | 829 | 1434 |
| 1385 VH3-23_IGHD4-17*01>3'_IGHJ6*01 | 2736 | L6_IGKJ1*01 | 829 | 1434 |
| 1386 VH3-23_IGHD4-23*01>1'_IGHJ6*01 | 2737 | L6_IGKJ1*01 | 829 | 1434 |
| 1387 VH3-23_IGHD4-23*01>3'_IGHJ6*01 | 2738 | L6_IGKJ1*01 | 829 | 1434 |
| 1388 VH3-23_IGHD5-5*01 (2) >1'_IGHJ6*01 | 2739 | L6_IGKJ1*01 | 829 | 1434 |
| 1389 VH3-23_IGHD5-5*01 (2) >3'_IGHJ6*01 | 2740 | L6_IGKJ1*01 | 829 | 1434 |
| 1390 VH3-23_IGHD5-12*01>1'_IGHJ6*01 | 2741 | L6_IGKJ1*01 | 829 | 1434 |
| 1391 VH3-23_IGHD5-12*01>3'_IGHJ6*01 | 2742 | L6_IGKJ1*01 | 829 | 1434 |
| 1392 VH3-23_IGHD5-18*01 (2) >1'_IGHJ6*01 | 2743 | L6_IGKJ1*01 | 829 | 1434 |
| 1393 VH3-23_IGHD5-18*01 (2) >3'_IGHJ6*01 | 2744 | L6_IGKJ1*01 | 829 | 1434 |
| 1394 VH3-23_IGHD5-24*01>1'_IGHJ6*01 | 2745 | L6_IGKJ1*01 | 829 | 1434 |
| 1395 VH3-23_IGHD5-24*01>3'_IGHJ6*01 | 2746 | L6_IGKJ1*01 | 829 | 1434 |
| 1396 VH3-23_IGHD6-6*01>1'_IGHJ6*01 | 2747 | L6_IGKJ1*01 | 829 | 1434 |
| 1397 VH3-23_IGHD6-6*01>2'_IGHJ6*01 | 2748 | L6_IGKJ1*01 | 829 | 1434 |
| 1398 VH3-23_IGHD6-6*01>3'_IGHJ6*01 | 2749 | L6_IGKJ1*01 | 829 | 1434 |
| 1399 VH3-23_IGHD1-1*01>1_IGHJ5*01 | 2530 | L25_IGKJ1*01 | 826 | 1431 |
| 1400 VH3-23_IGHD1-1*01>2_IGHJ5*01 | 2531 | L25_IGKJ1*01 | 826 | 1431 |
| 1401 VH3-23_IGHD1-1*01>3_IGHJ5*01 | 2532 | L25_IGKJ1*01 | 826 | 1431 |
| 1402 VH3-23_IGHD1-7*01>1_IGHJ5*01 | 2533 | L25_IGKJ1*01 | 826 | 1431 |
| 1403 VH3-23_IGHD1-7*01>3_IGHJ5*01 | 2534 | L25_IGKJ1*01 | 826 | 1431 |
| 1404 VH3-23_IGHD1-14*01>1_IGHJ5*01 | 2535 | L25_IGKJ1*01 | 826 | 1431 |
| 1405 VH3-23_IGHD1-14*01>3_IGHJ5*01 | 2536 | L25_IGKJ1*01 | 826 | 1431 |
| 1406 VH3-23_IGHD1-20*01>1_IGHJ5*01 | 2537 | L25_IGKJ1*01 | 826 | 1431 |
| 1407 VH3-23_IGHD1-20*01>3_IGHJ5*01 | 2538 | L25_IGKJ1*01 | 826 | 1431 |
| 1408 VH3-23_IGHD1-26*01>1_IGHJ5*01 | 2539 | L25_IGKJ1*01 | 826 | 1431 |
| 1409 VH3-23_IGHD1-26*01>3_IGHJ5*01 | 2540 | L25_IGKJ1*01 | 826 | 1431 |
| 1410 VH3-23_IGHD2-2*01>2_IGHJ5*01 | 2541 | L25_IGKJ1*01 | 826 | 1431 |
| 1411 VH3-23_IGHD2-2*01>3_IGHJ5*01 | 2542 | L25_IGKJ1*01 | 826 | 1431 |
| 1412 VH3-23_IGHD2-8*01>2_IGHJ5*01 | 2543 | L25_IGKJ1*01 | 826 | 1431 |
| 1413 VH3-23_IGHD2-8*01>3_IGHJ5*01 | 2544 | L25_IGKJ1*01 | 826 | 1431 |
| 1414 VH3-23_IGHD2-15*01>2_IGHJ5*01 | 2545 | L25_IGKJ1*01 | 826 | 1431 |
| 1415 VH3-23_IGHD2-15*01>3_IGHJ5*01 | 2546 | L25_IGKJ1*01 | 826 | 1431 |
| 1416 VH3-23_IGHD2-21*01>2_IGHJ5*01 | 2547 | L25_IGKJ1*01 | 826 | 1431 |
| 1417 VH3-23_IGHD2-21*01>3_IGHJ5*01 | 2548 | L25_IGKJ1*01 | 826 | 1431 |
| 1418 VH3-23_IGHD3-3*01>1_IGHJ5*01 | 2549 | L25_IGKJ1*01 | 826 | 1431 |
| 1419 VH3-23_IGHD3-3*01>2_IGHJ5*01 | 2550 | L25_IGKJ1*01 | 826 | 1431 |
| 1420 VH3-23_IGHD3-3*01>3_IGHJ5*01 | 2551 | L25_IGKJ1*01 | 826 | 1431 |
| 1421 VH3-23_IGHD3-9*01>2_IGHJ5*01 | 2552 | L25_IGKJ1*01 | 826 | 1431 |
| 1422 VH3-23_IGHD3-10*01>2_IGHJ5*01 | 2553 | L25_IGKJ1*01 | 826 | 1431 |
| 1423 VH3-23_IGHD3-10*01>3_IGHJ5*01 | 2554 | L25_IGKJ1*01 | 826 | 1431 |
| 1424 VH3-23_IGHD3-16*01>2_IGHJ5*01 | 2555 | L25_IGKJ1*01 | 826 | 1431 |
| 1425 VH3-23_IGHD3-16*01>3_IGHJ5*01 | 2556 | L25_IGKJ1*01 | 826 | 1431 |
| 1426 VH3-23_IGHD3-22*01>2_IGHJ5*01 | 2557 | L25_IGKJ1*01 | 826 | 1431 |
| 1427 VH3-23_IGHD3-22*01>3_IGHJ5*01 | 2558 | L25_IGKJ1*01 | 826 | 1431 |
| 1428 VH3-23_IGHD4-4*01 (1) >2_IGHJ5*01 | 2559 | L25_IGKJ1*01 | 826 | 1431 |
| 1429 VH3-23_IGHD4-4*01 (1) >3_IGHJ5*01 | 2560 | L25_IGKJ1*01 | 826 | 1431 |
| 1430 VH3-23_IGHD4-11*01 (1) >2_IGHJ5*01 | 2561 | L25_IGKJ1*01 | 826 | 1431 |
| 1431 VH3-23_IGHD4-11*01 (1) >3_IGHJ5*01 | 2562 | L25_IGKJ1*01 | 826 | 1431 |

TABLE 17A-continued

Exemplary Nucleic Acid Paired Library

| HEAVY CHAIN Name | RS SEQ ID NO | LIGHT CHAIN Name | RS SEQ ID NO | NO RS SEQ ID NO |
|---|---|---|---|---|
| 1432 VH3-23_IGHD4-17*01>2_IGHJ5*01 | 2563 | L25_IGKJ1*01 | 826 | 1431 |
| 1433 VH3-23_IGHD4-17*01>3_IGHJ5*01 | 2564 | L25_IGKJ1*01 | 826 | 1431 |
| 1434 VH3-23_IGHD4-23*01>2_IGHJ5*01 | 2565 | L25_IGKJ1*01 | 826 | 1431 |
| 1435 VH3-23_IGHD4-23*01>3_IGHJ5*01 | 2566 | L25_IGKJ1*01 | 826 | 1431 |
| 1436 VH3-23_IGHD5-5*01 (2) >1_IGHJ5*01 | 2567 | L25_IGKJ1*01 | 826 | 1431 |
| 1437 VH3-23_IGHD5-5*01 (2) >2_IGHJ5*01 | 2568 | L25_IGKJ1*01 | 826 | 1431 |
| 1438 VH3-23_IGHD5-5*01 (2) >3_IGHJ5*01 | 2569 | L25_IGKJ1*01 | 826 | 1431 |
| 1439 VH3-23_IGHD5-12*01>1_IGHJ5*01 | 2570 | L25_IGKJ1*01 | 826 | 1431 |
| 1440 VH3-23_IGHD5-12*01>3_IGHJ5*01 | 2571 | L25_IGKJ1*01 | 826 | 1431 |
| 1441 VH3-23_IGHD5-18*01 (2) >1_IGHJ5*01 | 2572 | L25_IGKJ1*01 | 826 | 1431 |
| 1442 VH3-23_IGHD5-18*01 (2) >2_IGHJ5*01 | 2573 | L25_IGKJ1*01 | 826 | 1431 |
| 1443 VH3-23_IGHD5-18*01 (2) >3_IGHJ5*01 | 2574 | L25_IGKJ1*01 | 826 | 1431 |
| 1444 VH3-23_IGHD5-24*01>1_IGHJ5*01 | 2575 | L25_IGKJ1*01 | 826 | 1431 |
| 1445 VH3-23_IGHD5-24*01>3_IGHJ5*01 | 2576 | L25_IGKJ1*01 | 826 | 1431 |
| 1446 VH3-23_IGHD6-6*01>1_IGHJ5*01 | 2577 | L25_IGKJ1*01 | 826 | 1431 |
| 1447 VH3-23_IGHD1-1*01>1'_IGHJ5*01 | 2587 | L25_IGKJ1*01 | 826 | 1431 |
| 1448 VH3-23_IGHD1-1*01>2'_IGHJ5*01 | 2588 | L25_IGKJ1*01 | 826 | 1431 |
| 1449 VH3-23_IGHD1-1*01>3'_IGHJ5*01 | 2589 | L25_IGKJ1*01 | 826 | 1431 |
| 1450 VH3-23_IGHD1-7*01>1'_IGHJ5*01 | 2590 | L25_IGKJ1*01 | 826 | 1431 |
| 1451 VH3-23_IGHD1-7*01>3'_IGHJ5*01 | 2591 | L25_IGKJ1*01 | 826 | 1431 |
| 1452 VH3-23_IGHD1-14*01>1'_IGHJ5*01 | 2592 | L25_IGKJ1*01 | 826 | 1431 |
| 1453 VH3-23_IGHD1-14*01>2'_IGHJ5*01 | 2593 | L25_IGKJ1*01 | 826 | 1431 |
| 1454 VH3-23_IGHD1-14*01>3'_IGHJ5*01 | 2594 | L25_IGKJ1*01 | 826 | 1431 |
| 1455 VH3-23_IGHD1-20*01>1'_IGHJ5*01 | 2595 | L25_IGKJ1*01 | 826 | 1431 |
| 1456 VH3-23_IGHD1-20*01>2'_IGHJ5*01 | 2596 | L25_IGKJ1*01 | 826 | 1431 |
| 1457 VH3-23_IGHD1-20*01>3'_IGHJ5*01 | 2597 | L25_IGKJ1*01 | 826 | 1431 |
| 1458 VH3-23_IGHD1-26*01>1'_IGHJ5*01 | 2598 | L25_IGKJ1*01 | 826 | 1431 |
| 1459 VH3-23_IGHD1-26*01>3'_IGHJ5*01 | 2599 | L25_IGKJ1*01 | 826 | 1431 |
| 1460 VH3-23_IGHD2-2*01>1'_IGHJ5*01 | 2600 | L25_IGKJ1*01 | 826 | 1431 |
| 1461 VH3-23_IGHD2-2*01>3'_IGHJ5*01 | 2601 | L25_IGKJ1*01 | 826 | 1431 |
| 1462 VH3-23_IGHD2-8*01>1'_IGHJ5*01 | 2602 | L25_IGKJ1*01 | 826 | 1431 |
| 1463 VH3-23_IGHD2-15*01>1'_IGHJ5*01 | 2603 | L25_IGKJ1*01 | 826 | 1431 |
| 1464 VH3-23_IGHD2-15*01>3'_IGHJ5*01 | 2604 | L25_IGKJ1*01 | 826 | 1431 |
| 1465 VH3-23_IGHD2-21*01>1'_IGHJ5*01 | 2605 | L25_IGKJ1*01 | 826 | 1431 |
| 1466 VH3-23_IGHD2-21*01>3'_IGHJ5*01 | 2606 | L25_IGKJ1*01 | 826 | 1431 |
| 1467 VH3-23_IGHD3-3*01>1'_IGHJ5*01 | 2607 | L25_IGKJ1*01 | 826 | 1431 |
| 1468 VH3-23_IGHD3-3*01>3'_IGHJ5*01 | 2608 | L25_IGKJ1*01 | 826 | 1431 |
| 1469 VH3-23_IGHD3-9*01>1'_IGHJ5*01 | 2609 | L25_IGKJ1*01 | 826 | 1431 |
| 1470 VH3-23_IGHD3-9*01>3'_IGHJ5*01 | 2610 | L25_IGKJ1*01 | 826 | 1431 |
| 1471 VH3-23_IGHD3-10*01>1'_IGHJ5*01 | 2611 | L25_IGKJ1*01 | 826 | 1431 |
| 1472 VH3-23_IGHD3-10*01>3'_IGHJ5*01 | 2612 | L25_IGKJ1*01 | 826 | 1431 |
| 1473 VH3-23_IGHD3-16*01>1'_IGHJ5*01 | 2613 | L25_IGKJ1*01 | 826 | 1431 |
| 1474 VH3-23_IGHD3-16*01>3'_IGHJ5*01 | 2614 | L25_IGKJ1*01 | 826 | 1431 |
| 1475 VH3-23_IGHD3-22*01>1'_IGHJ5*01 | 2615 | L25_IGKJ1*01 | 826 | 1431 |
| 1476 VH3-23_IGHD4-4*01 (1) >1'_IGHJ5*01 | 2616 | L25_IGKJ1*01 | 826 | 1431 |
| 1477 VH3-23_IGHD4-4*01 (1) >3'_IGHJ5*01 | 2617 | L25_IGKJ1*01 | 826 | 1431 |
| 1478 VH3-23_IGHD4-11*01 (1) >1'_IGHJ5*01 | 2618 | L25_IGKJ1*01 | 826 | 1431 |
| 1479 VH3-23_IGHD4-11*01 (1) >3'_IGHJ5*01 | 2619 | L25_IGKJ1*01 | 826 | 1431 |
| 1480 VH3-23_IGHD4-17*01>1'_IGHJ5*01 | 2620 | L25_IGKJ1*01 | 826 | 1431 |
| 1481 VH3-23_IGHD4-17*01>3'_IGHJ5*01 | 2621 | L25_IGKJ1*01 | 826 | 1431 |
| 1482 VH3-23_IGHD4-23*01>1'_IGHJ5*01 | 2622 | L25_IGKJ1*01 | 826 | 1431 |
| 1483 VH3-23_IGHD4-23*01>3'_IGHJ5*01 | 2623 | L25_IGKJ1*01 | 826 | 1431 |
| 1484 VH3-23_IGHD5-5*01 (2) >1'_IGHJ5*01 | 2624 | L25_IGKJ1*01 | 826 | 1431 |
| 1485 VH3-23_IGHD5-5*01 (2) >3'_IGHJ5*01 | 2625 | L25_IGKJ1*01 | 826 | 1431 |
| 1486 VH3-23_IGHD5-12*01>1'_IGHJ5*01 | 2626 | L25_IGKJ1*01 | 826 | 1431 |
| 1487 VH3-23_IGHD5-12*01>3'_IGHJ5*01 | 2627 | L25_IGKJ1*01 | 826 | 1431 |
| 1488 VH3-23_IGHD5-18*01 (2) >1'_IGHJ5*01 | 2628 | L25_IGKJ1*01 | 826 | 1431 |
| 1489 VH3-23_IGHD5-18*01 (2) >3'_IGHJ5*01 | 2629 | L25_IGKJ1*01 | 826 | 1431 |
| 1490 VH3-23_IGHD5-24*01>1'_IGHJ5*01 | 2630 | L25_IGKJ1*01 | 826 | 1431 |
| 1491 VH3-23_IGHD5-24*01>3'_IGHJ5*01 | 2631 | L25_IGKJ1*01 | 826 | 1431 |
| 1492 VH3-23_IGHD6-6*01>1'_IGHJ5*01 | 2632 | L25_IGKJ1*01 | 826 | 1431 |
| 1493 VH3-23_IGHD6-6*01>2'_IGHJ5*01 | 2633 | L25_IGKJ1*01 | 826 | 1431 |
| 1494 VH3-23_IGHD6-6*01>3'_IGHJ5*01 | 2634 | L25_IGKJ1*01 | 826 | 1431 |
| 1495 VH3-23_IGHD1-1*01>1_IGHJ5*01 | 2530 | B3_IGKJ1*01 | 817 | 1422 |
| 1496 VH3-23_IGHD1-1*01>2_IGHJ5*01 | 2531 | B3_IGKJ1*01 | 817 | 1422 |
| 1497 VH3-23_IGHD1-1*01>3_IGHJ5*01 | 2532 | B3_IGKJ1*01 | 817 | 1422 |
| 1498 VH3-23_IGHD1-7*01>1_IGHJ5*01 | 2533 | B3_IGKJ1*01 | 817 | 1422 |
| 1499 VH3-23_IGHD1-7*01>3_IGHJ5*01 | 2534 | B3_IGKJ1*01 | 817 | 1422 |
| 1500 VH3-23_IGHD1-14*01>1_IGHJ5*01 | 2535 | B3_IGKJ1*01 | 817 | 1422 |
| 1501 VH3-23_IGHD1-14*01>3_IGHJ5*01 | 2536 | B3_IGKJ1*01 | 817 | 1422 |
| 1502 VH3-23_IGHD1-20*01>1_IGHJ5*01 | 2537 | B3_IGKJ1*01 | 817 | 1422 |
| 1503 VH3-23_IGHD1-20*01>3_IGHJ5*01 | 2538 | B3_IGKJ1*01 | 817 | 1422 |
| 1504 VH3-23_IGHD1-26*01>1_IGHJ5*01 | 2539 | B3_IGKJ1*01 | 817 | 1422 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 1505 | VH3-23_IGHD1-26*01>3_IGHJ5*01 | 2540 | B3_IGKJ1*01 | 817 | 1422 |
| 1506 | VH3-23_IGHD2-2*01>2_IGHJ5*01 | 2541 | B3_IGKJ1*01 | 817 | 1422 |
| 1507 | VH3-23_IGHD2-2*01>3_IGHJ5*01 | 2542 | B3_IGKJ1*01 | 817 | 1422 |
| 1508 | VH3-23_IGHD2-8*01>2_IGHJ5*01 | 2543 | B3_IGKJ1*01 | 817 | 1422 |
| 1509 | VH3-23_IGHD2-8*01>3_IGHJ5*01 | 2544 | B3_IGKJ1*01 | 817 | 1422 |
| 1510 | VH3-23_IGHD2-15*01>2_IGHJ5*01 | 2545 | B3_IGKJ1*01 | 817 | 1422 |
| 1511 | VH3-23_IGHD2-15*01>3_IGHJ5*01 | 2546 | B3_IGKJ1*01 | 817 | 1422 |
| 1512 | VH3-23_IGHD2-21*01>2_IGHJ5*01 | 2547 | B3_IGKJ1*01 | 817 | 1422 |
| 1513 | VH3-23_IGHD2-21*01>3_IGHJ5*01 | 2548 | B3_IGKJ1*01 | 817 | 1422 |
| 1514 | VH3-23_IGHD3-3*01>1_IGHJ5*01 | 2549 | B3_IGKJ1*01 | 817 | 1422 |
| 1515 | VH3-23_IGHD3-3*01>2_IGHJ5*01 | 2550 | B3_IGKJ1*01 | 817 | 1422 |
| 1516 | VH3-23_IGHD3-3*01>3_IGHJ5*01 | 2551 | B3_IGKJ1*01 | 817 | 1422 |
| 1517 | VH3-23_IGHD3-9*01>2_IGHJ5*01 | 2552 | B3_IGKJ1*01 | 817 | 1422 |
| 1518 | VH3-23_IGHD3-10*01>2_IGHJ5*01 | 2553 | B3_IGKJ1*01 | 817 | 1422 |
| 1519 | VH3-23_IGHD3-10*01>3_IGHJ5*01 | 2554 | B3_IGKJ1*01 | 817 | 1422 |
| 1520 | VH3-23_IGHD3-16*01>2_IGHJ5*01 | 2555 | B3_IGKJ1*01 | 817 | 1422 |
| 1521 | VH3-23_IGHD3-16*01>3_IGHJ5*01 | 2556 | B3_IGKJ1*01 | 817 | 1422 |
| 1522 | VH3-23_IGHD3-22*01>2_IGHJ5*01 | 2557 | B3_IGKJ1*01 | 817 | 1422 |
| 1523 | VH3-23_IGHD3-22*01>3_IGHJ5*01 | 2558 | B3_IGKJ1*01 | 817 | 1422 |
| 1524 | VH3-23_IGHD4-4*01 (1) >2_IGHJ5*01 | 2559 | B3_IGKJ1*01 | 817 | 1422 |
| 1525 | VH3-23_IGHD4-4*01 (1) >3_IGHJ5*01 | 2560 | B3_IGKJ1*01 | 817 | 1422 |
| 1526 | VH3-23_IGHD4-11*01 (1) >2_IGHJ5*01 | 2561 | B3_IGKJ1*01 | 817 | 1422 |
| 1527 | VH3-23_IGHD4-11*01 (1) >3_IGHJ5*01 | 2562 | B3_IGKJ1*01 | 817 | 1422 |
| 1528 | VH3-23_IGHD4-17*01>2_IGHJ5*01 | 2563 | B3_IGKJ1*01 | 817 | 1422 |
| 1529 | VH3-23_IGHD4-17*01>3_IGHJ5*01 | 2564 | B3_IGKJ1*01 | 817 | 1422 |
| 1530 | VH3-23_IGHD4-23*01>2_IGHJ5*01 | 2565 | B3_IGKJ1*01 | 817 | 1422 |
| 1531 | VH3-23_IGHD4-23*01>3_IGHJ5*01 | 2566 | B3_IGKJ1*01 | 817 | 1422 |
| 1532 | VH3-23_IGHD5-5*01 (2) >1_IGHJ5*01 | 2567 | B3_IGKJ1*01 | 817 | 1422 |
| 1533 | VH3-23_IGHD5-5*01 (2) >2_IGHJ5*01 | 2568 | B3_IGKJ1*01 | 817 | 1422 |
| 1534 | VH3-23_IGHD5-5*01 (2) >3_IGHJ5*01 | 2569 | B3_IGKJ1*01 | 817 | 1422 |
| 1535 | VH3-23_IGHD5-12*01>1_IGHJ5*01 | 2570 | B3_IGKJ1*01 | 817 | 1422 |
| 1536 | VH3-23_IGHD5-12*01>3_IGHJ5*01 | 2571 | B3_IGKJ1*01 | 817 | 1422 |
| 1537 | VH3-23_IGHD5-18*01 (2) >1_IGHJ5*01 | 2572 | B3_IGKJ1*01 | 817 | 1422 |
| 1538 | VH3-23_IGHD5-18*01 (2) >2_IGHJ5*01 | 2573 | B3_IGKJ1*01 | 817 | 1422 |
| 1539 | VH3-23_IGHD5-18*01 (2) >3_IGHJ5*01 | 2574 | B3_IGKJ1*01 | 817 | 1422 |
| 1540 | VH3-23_IGHD5-24*01>1_IGHJ5*01 | 2575 | B3_IGKJ1*01 | 817 | 1422 |
| 1541 | VH3-23_IGHD5-24*01>3_IGHJ5*01 | 2576 | B3_IGKJ1*01 | 817 | 1422 |
| 1542 | VH3-23_IGHD6-6*01>1_IGHJ5*01 | 2577 | B3_IGKJ1*01 | 817 | 1422 |
| 1543 | VH3-23_IGHD1-1*01>1'_IGHJ5*01 | 2587 | B3_IGKJ1*01 | 817 | 1422 |
| 1544 | VH3-23_IGHD1-1*01>2'_IGHJ5*01 | 2588 | B3_IGKJ1*01 | 817 | 1422 |
| 1545 | VH3-23_IGHD1-1*01>3'_IGHJ5*01 | 2589 | B3_IGKJ1*01 | 817 | 1422 |
| 1546 | VH3-23_IGHD1-7*01>1'_IGHJ5*01 | 2590 | B3_IGKJ1*01 | 817 | 1422 |
| 1547 | VH3-23_IGHD1-7*01>3'_IGHJ5*01 | 2591 | B3_IGKJ1*01 | 817 | 1422 |
| 1548 | VH3-23_IGHD1-14*01>1'_IGHJ5*01 | 2592 | B3_IGKJ1*01 | 817 | 1422 |
| 1549 | VH3-23_IGHD1-14*01>2'_IGHJ5*01 | 2593 | B3_IGKJ1*01 | 817 | 1422 |
| 1550 | VH3-23_IGHD1-14*01>3'_IGHJ5*01 | 2594 | B3_IGKJ1*01 | 817 | 1422 |
| 1551 | VH3-23_IGHD1-20*01>1'_IGHJ5*01 | 2595 | B3_IGKJ1*01 | 817 | 1422 |
| 1552 | VH3-23_IGHD1-20*01>2'_IGHJ5*01 | 2596 | B3_IGKJ1*01 | 817 | 1422 |
| 1553 | VH3-23_IGHD1-20*01>3'_IGHJ5*01 | 2597 | B3_IGKJ1*01 | 817 | 1422 |
| 1554 | VH3-23_IGHD1-26*01>1'_IGHJ5*01 | 2598 | B3_IGKJ1*01 | 817 | 1422 |
| 1555 | VH3-23_IGHD1-26*01>3'_IGHJ5*01 | 2599 | B3_IGKJ1*01 | 817 | 1422 |
| 1556 | VH3-23_IGHD2-2*01>1'_IGHJ5*01 | 2600 | B3_IGKJ1*01 | 817 | 1422 |
| 1557 | VH3-23_IGHD2-2*01>3'_IGHJ5*01 | 2601 | B3_IGKJ1*01 | 817 | 1422 |
| 1558 | VH3-23_IGHD2-8*01>1'_IGHJ5*01 | 2602 | B3_IGKJ1*01 | 817 | 1422 |
| 1559 | VH3-23_IGHD2-15*01>1'_IGHJ5*01 | 2603 | B3_IGKJ1*01 | 817 | 1422 |
| 1560 | VH3-23_IGHD2-15*01>3'_IGHJ5*01 | 2604 | B3_IGKJ1*01 | 817 | 1422 |
| 1561 | VH3-23_IGHD2-21*01>1'_IGHJ5*01 | 2605 | B3_IGKJ1*01 | 817 | 1422 |
| 1562 | VH3-23_IGHD2-21*01>3'_IGHJ5*01 | 2606 | B3_IGKJ1*01 | 817 | 1422 |
| 1563 | VH3-23_IGHD3-3*01>1'_IGHJ5*01 | 2607 | B3_IGKJ1*01 | 817 | 1422 |
| 1564 | VH3-23_IGHD3-3*01>3'_IGHJ5*01 | 2608 | B3_IGKJ1*01 | 817 | 1422 |
| 1565 | VH3-23_IGHD3-9*01>1'_IGHJ5*01 | 2609 | B3_IGKJ1*01 | 817 | 1422 |
| 1566 | VH3-23_IGHD3-9*01>3'_IGHJ5*01 | 2610 | B3_IGKJ1*01 | 817 | 1422 |
| 1567 | VH3-23_IGHD3-10*01>1'_IGHJ5*01 | 2611 | B3_IGKJ1*01 | 817 | 1422 |
| 1568 | VH3-23_IGHD3-10*01>3'_IGHJ5*01 | 2612 | B3_IGKJ1*01 | 817 | 1422 |
| 1569 | VH3-23_IGHD3-16*01>1'_IGHJ5*01 | 2613 | B3_IGKJ1*01 | 817 | 1422 |
| 1570 | VH3-23_IGHD3-16*01>3'_IGHJ5*01 | 2614 | B3_IGKJ1*01 | 817 | 1422 |
| 1571 | VH3-23_IGHD3-22*01>1'_IGHJ5*01 | 2615 | B3_IGKJ1*01 | 817 | 1422 |
| 1572 | VH3-23_IGHD4-4*01 (1) >1'_IGHJ5*01 | 2616 | B3_IGKJ1*01 | 817 | 1422 |
| 1573 | VH3-23_IGHD4-4*01 (1) >3'_IGHJ5*01 | 2617 | B3_IGKJ1*01 | 817 | 1422 |
| 1574 | VH3-23_IGHD4-11*01 (1) >1'_IGHJ5*01 | 2618 | B3_IGKJ1*01 | 817 | 1422 |
| 1575 | VH3-23_IGHD4-11*01 (1) >3'_IGHJ5*01 | 2619 | B3_IGKJ1*01 | 817 | 1422 |
| 1576 | VH3-23_IGHD4-17*01>1'_IGHJ5*01 | 2620 | B3_IGKJ1*01 | 817 | 1422 |
| 1577 | VH3-23_IGHD4-17*01>3'_IGHJ5*01 | 2621 | B3_IGKJ1*01 | 817 | 1422 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 1578 | VH3-23_IGHD4-23*01>1'_IGHJ5*01 | 2622 | B3_IGKJ1*01 | 817 | 1422 |
| 1579 | VH3-23_IGHD4-23*01>3'_IGHJ5*01 | 2623 | B3_IGKJ1*01 | 817 | 1422 |
| 1580 | VH3-23_IGHD5-5*01 (2) >1'_IGHJ5*01 | 2624 | B3_IGKJ1*01 | 817 | 1422 |
| 1581 | VH3-23_IGHD5-5*01 (2) >3'_IGHJ5*01 | 2625 | B3_IGKJ1*01 | 817 | 1422 |
| 1582 | VH3-23_IGHD5-12*01>1'_IGHJ5*01 | 2626 | B3_IGKJ1*01 | 817 | 1422 |
| 1583 | VH3-23_IGHD5-12*01>3'_IGHJ5*01 | 2627 | B3_IGKJ1*01 | 817 | 1422 |
| 1584 | VH3-23_IGHD5-18*01 (2) >1'_IGHJ5*01 | 2628 | B3_IGKJ1*01 | 817 | 1422 |
| 1585 | VH3-23_IGHD5-18*01 (2) >3'_IGHJ5*01 | 2629 | B3_IGKJ1*01 | 817 | 1422 |
| 1586 | VH3-23_IGHD5-24*01>1'_IGHJ5*01 | 2630 | B3_IGKJ1*01 | 817 | 1422 |
| 1587 | VH3-23_IGHD5-24*01>3'_IGHJ5*01 | 2631 | B3_IGKJ1*01 | 817 | 1422 |
| 1588 | VH3-23_IGHD6-6*01>1'_IGHJ5*01 | 2632 | B3_IGKJ1*01 | 817 | 1422 |
| 1589 | VH3-23_IGHD6-6*01>2'_IGHJ5*01 | 2633 | B3_IGKJ1*01 | 817 | 1422 |
| 1590 | VH3-23_IGHD6-6*01>3'_IGHJ5*01 | 2634 | B3_IGKJ1*01 | 817 | 1422 |
| 1591 | VH3-23_IGHD1-1*01>1_IGHJ5*01 | 2530 | A26_IGKJ1*01 | 811 | 1416 |
| 1592 | VH3-23_IGHD1-1*01>2_IGHJ5*01 | 2531 | A26_IGKJ1*01 | 811 | 1416 |
| 1593 | VH3-23_IGHD1-1*01>3_IGHJ5*01 | 2532 | A26_IGKJ1*01 | 811 | 1416 |
| 1594 | VH3-23_IGHD1-7*01>1_IGHJ5*01 | 2533 | A26_IGKJ1*01 | 811 | 1416 |
| 1595 | VH3-23_IGHD1-7*01>3_IGHJ5*01 | 2534 | A26_IGKJ1*01 | 811 | 1416 |
| 1596 | VH3-23_IGHD1-14*01>1_IGHJ5*01 | 2535 | A26_IGKJ1*01 | 811 | 1416 |
| 1597 | VH3-23_IGHD1-14*01>3_IGHJ5*01 | 2536 | A26_IGKJ1*01 | 811 | 1416 |
| 1598 | VH3-23_IGHD1-20*01>1_IGHJ5*01 | 2537 | A26_IGKJ1*01 | 811 | 1416 |
| 1599 | VH3-23_IGHD1-20*01>3_IGHJ5*01 | 2538 | A26_IGKJ1*01 | 811 | 1416 |
| 1600 | VH3-23_IGHD1-26*01>1_IGHJ5*01 | 2539 | A26_IGKJ1*01 | 811 | 1416 |
| 1601 | VH3-23_IGHD1-26*01>3_IGHJ5*01 | 2540 | A26_IGKJ1*01 | 811 | 1416 |
| 1602 | VH3-23_IGHD2-2*01>2_IGHJ5*01 | 2541 | A26_IGKJ1*01 | 811 | 1416 |
| 1603 | VH3-23_IGHD2-2*01>3_IGHJ5*01 | 2542 | A26_IGKJ1*01 | 811 | 1416 |
| 1604 | VH3-23_IGHD2-8*01>2_IGHJ5*01 | 2543 | A26_IGKJ1*01 | 811 | 1416 |
| 1605 | VH3-23_IGHD2-8*01>3_IGHJ5*01 | 2544 | A26_IGKJ1*01 | 811 | 1416 |
| 1606 | VH3-23_IGHD2-15*01>2_IGHJ5*01 | 2545 | A26_IGKJ1*01 | 811 | 1416 |
| 1607 | VH3-23_IGHD2-15*01>3_IGHJ5*01 | 2546 | A26_IGKJ1*01 | 811 | 1416 |
| 1608 | VH3-23_IGHD2-21*01>2_IGHJ5*01 | 2547 | A26_IGKJ1*01 | 811 | 1416 |
| 1609 | VH3-23_IGHD2-21*01>3_IGHJ5*01 | 2548 | A26_IGKJ1*01 | 811 | 1416 |
| 1610 | VH3-23_IGHD3-3*01>1_IGHJ5*01 | 2549 | A26_IGKJ1*01 | 811 | 1416 |
| 1611 | VH3-23_IGHD3-3*01>2_IGHJ5*01 | 2550 | A26_IGKJ1*01 | 811 | 1416 |
| 1612 | VH3-23_IGHD3-3*01>3_IGHJ5*01 | 2551 | A26_IGKJ1*01 | 811 | 1416 |
| 1613 | VH3-23_IGHD3-9*01>2_IGHJ5*01 | 2552 | A26_IGKJ1*01 | 811 | 1416 |
| 1614 | VH3-23_IGHD3-10*01>2_IGHJ5*01 | 2553 | A26_IGKJ1*01 | 811 | 1416 |
| 1615 | VH3-23_IGHD3-10*01>3_IGHJ5*01 | 2554 | A26_IGKJ1*01 | 811 | 1416 |
| 1616 | VH3-23_IGHD3-16*01>2_IGHJ5*01 | 2555 | A26_IGKJ1*01 | 811 | 1416 |
| 1617 | VH3-23_IGHD3-16*01>3_IGHJ5*01 | 2556 | A26_IGKJ1*01 | 811 | 1416 |
| 1618 | VH3-23_IGHD3-22*01>2_IGHJ5*01 | 2557 | A26_IGKJ1*01 | 811 | 1416 |
| 1619 | VH3-23_IGHD3-22*01>3_IGHJ5*01 | 2558 | A26_IGKJ1*01 | 811 | 1416 |
| 1620 | VH3-23_IGHD4-4*01 (1) >2_IGHJ5*01 | 2559 | A26_IGKJ1*01 | 811 | 1416 |
| 1621 | VH3-23_IGHD4-4*01 (1) >3_IGHJ5*01 | 2560 | A26_IGKJ1*01 | 811 | 1416 |
| 1622 | VH3-23_IGHD4-11*01 (1) >2_IGHJ5*01 | 2561 | A26_IGKJ1*01 | 811 | 1416 |
| 1623 | VH3-23_IGHD4-11*01 (1) >3_IGHJ5*01 | 2562 | A26_IGKJ1*01 | 811 | 1416 |
| 1624 | VH3-23_IGHD4-17*01>2_IGHJ5*01 | 2563 | A26_IGKJ1*01 | 811 | 1416 |
| 1625 | VH3-23_IGHD4-17*01>3_IGHJ5*01 | 2564 | A26_IGKJ1*01 | 811 | 1416 |
| 1626 | VH3-23_IGHD4-23*01>2_IGHJ5*01 | 2565 | A26_IGKJ1*01 | 811 | 1416 |
| 1627 | VH3-23_IGHD4-23*01>3_IGHJ5*01 | 2566 | A26_IGKJ1*01 | 811 | 1416 |
| 1628 | VH3-23_IGHD5-5*01 (2) >1_IGHJ5*01 | 2567 | A26_IGKJ1*01 | 811 | 1416 |
| 1629 | VH3-23_IGHD5-5*01 (2) >2_IGHJ5*01 | 2568 | A26_IGKJ1*01 | 811 | 1416 |
| 1630 | VH3-23_IGHD5-5*01 (2) >3_IGHJ5*01 | 2569 | A26_IGKJ1*01 | 811 | 1416 |
| 1631 | VH3-23_IGHD5-12*01>1_IGHJ5*01 | 2570 | A26_IGKJ1*01 | 811 | 1416 |
| 1632 | VH3-23_IGHD5-12*01>3_IGHJ5*01 | 2571 | A26_IGKJ1*01 | 811 | 1416 |
| 1633 | VH3-23_IGHD5-18*01 (2) >1_IGHJ5*01 | 2572 | A26_IGKJ1*01 | 811 | 1416 |
| 1634 | VH3-23_IGHD5-18*01 (2) >2_IGHJ5*01 | 2573 | A26_IGKJ1*01 | 811 | 1416 |
| 1635 | VH3-23_IGHD5-18*01 (2) >3_IGHJ5*01 | 2574 | A26_IGKJ1*01 | 811 | 1416 |
| 1636 | VH3-23_IGHD5-24*01>1_IGHJ5*01 | 2575 | A26_IGKJ1*01 | 811 | 1416 |
| 1637 | VH3-23_IGHD5-24*01>3_IGHJ5*01 | 2576 | A26_IGKJ1*01 | 811 | 1416 |
| 1638 | VH3-23_IGHD6-6*01>1_IGHJ5*01 | 2577 | A26_IGKJ1*01 | 811 | 1416 |
| 1639 | VH3-23_IGHD1-1*01>1'_IGHJ5*01 | 2587 | A26_IGKJ1*01 | 811 | 1416 |
| 1640 | VH3-23_IGHD1-1*01>2'_IGHJ5*01 | 2588 | A26_IGKJ1*01 | 811 | 1416 |
| 1641 | VH3-23_IGHD1-1*01>3'_IGHJ5*01 | 2589 | A26_IGKJ1*01 | 811 | 1416 |
| 1642 | VH3-23_IGHD1-7*01>1'_IGHJ5*01 | 2590 | A26_IGKJ1*01 | 811 | 1416 |
| 1643 | VH3-23_IGHD1-7*01>3'_IGHJ5*01 | 2591 | A26_IGKJ1*01 | 811 | 1416 |
| 1644 | VH3-23_IGHD1-14*01>1'_IGHJ5*01 | 2592 | A26_IGKJ1*01 | 811 | 1416 |
| 1645 | VH3-23_IGHD1-14*01>2'_IGHJ5*01 | 2593 | A26_IGKJ1*01 | 811 | 1416 |
| 1646 | VH3-23_IGHD1-14*01>3'_IGHJ5*01 | 2594 | A26_IGKJ1*01 | 811 | 1416 |
| 1647 | VH3-23_IGHD1-20*01>1'_IGHJ5*01 | 2595 | A26_IGKJ1*01 | 811 | 1416 |
| 1648 | VH3-23_IGHD1-20*01>2'_IGHJ5*01 | 2596 | A26_IGKJ1*01 | 811 | 1416 |
| 1649 | VH3-23_IGHD1-20*01>3'_IGHJ5*01 | 2597 | A26_IGKJ1*01 | 811 | 1416 |
| 1650 | VH3-23_IGHD1-26*01>1'_IGHJ5*01 | 2598 | A26_IGKJ1*01 | 811 | 1416 |

TABLE 17A-continued

Exemplary Nucleic Acid Paired Library

| HEAVY CHAIN Name | RS SEQ ID NO | LIGHT CHAIN Name | RS SEQ ID NO | NO RS SEQ ID NO |
|---|---|---|---|---|
| 1651 VH3-23_IGHD1-26*01>3'_IGHJ5*01 | 2599 | A26_IGKJ1*01 | 811 | 1416 |
| 1652 VH3-23_IGHD2-2*01>1'_IGHJ5*01 | 2600 | A26_IGKJ1*01 | 811 | 1416 |
| 1653 VH3-23_IGHD2-2*01>3'_IGHJ5*01 | 2601 | A26_IGKJ1*01 | 811 | 1416 |
| 1654 VH3-23_IGHD2-8*01>1'_IGHJ5*01 | 2602 | A26_IGKJ1*01 | 811 | 1416 |
| 1655 VH3-23_IGHD2-15*01>1'_IGHJ5*01 | 2603 | A26_IGKJ1*01 | 811 | 1416 |
| 1656 VH3-23_IGHD2-15*01>3'_IGHJ5*01 | 2604 | A26_IGKJ1*01 | 811 | 1416 |
| 1657 VH3-23_IGHD2-21*01>1'_IGHJ5*01 | 2605 | A26_IGKJ1*01 | 811 | 1416 |
| 1658 VH3-23_IGHD2-21*01>3'_IGHJ5*01 | 2606 | A26_IGKJ1*01 | 811 | 1416 |
| 1659 VH3-23_IGHD3-3*01>1'_IGHJ5*01 | 2607 | A26_IGKJ1*01 | 811 | 1416 |
| 1660 VH3-23_IGHD3-3*01>3'_IGHJ5*01 | 2608 | A26_IGKJ1*01 | 811 | 1416 |
| 1661 VH3-23_IGHD3-9*01>1'_IGHJ5*01 | 2609 | A26_IGKJ1*01 | 811 | 1416 |
| 1662 VH3-23_IGHD3-9*01>3'_IGHJ5*01 | 2610 | A26_IGKJ1*01 | 811 | 1416 |
| 1663 VH3-23_IGHD3-10*01>1'_IGHJ5*01 | 2611 | A26_IGKJ1*01 | 811 | 1416 |
| 1664 VH3-23_IGHD3-10*01>3'_IGHJ5*01 | 2612 | A26_IGKJ1*01 | 811 | 1416 |
| 1665 VH3-23_IGHD3-16*01>1'_IGHJ5*01 | 2613 | A26_IGKJ1*01 | 811 | 1416 |
| 1666 VH3-23_IGHD3-16*01>3'_IGHJ5*01 | 2614 | A26_IGKJ1*01 | 811 | 1416 |
| 1667 VH3-23_IGHD3-22*01>1'_IGHJ5*01 | 2615 | A26_IGKJ1*01 | 811 | 1416 |
| 1668 VH3-23_IGHD4-4*01 (1) >1'_IGHJ5*01 | 2616 | A26_IGKJ1*01 | 811 | 1416 |
| 1669 VH3-23_IGHD4-4*01 (1) >3'_IGHJ5*01 | 2617 | A26_IGKJ1*01 | 811 | 1416 |
| 1670 VH3-23_IGHD4-11*01 (1) >1'_IGHJ5*01 | 2618 | A26_IGKJ1*01 | 811 | 1416 |
| 1671 VH3-23_IGHD4-11*01 (1) >3'_IGHJ5*01 | 2619 | A26_IGKJ1*01 | 811 | 1416 |
| 1672 VH3-23_IGHD4-17*01>1'_IGHJ5*01 | 2620 | A26_IGKJ1*01 | 811 | 1416 |
| 1673 VH3-23_IGHD4-17*01>3'_IGHJ5*01 | 2621 | A26_IGKJ1*01 | 811 | 1416 |
| 1674 VH3-23_IGHD4-23*01>1'_IGHJ5*01 | 2622 | A26_IGKJ1*01 | 811 | 1416 |
| 1675 VH3-23_IGHD4-23*01>3'_IGHJ5*01 | 2623 | A26_IGKJ1*01 | 811 | 1416 |
| 1676 VH3-23_IGHD5-5*01 (2) >1'_IGHJ5*01 | 2624 | A26_IGKJ1*01 | 811 | 1416 |
| 1677 VH3-23_IGHD5-5*01 (2) >3'_IGHJ5*01 | 2625 | A26_IGKJ1*01 | 811 | 1416 |
| 1678 VH3-23_IGHD5-12*01>1'_IGHJ5*01 | 2626 | A26_IGKJ1*01 | 811 | 1416 |
| 1679 VH3-23_IGHD5-12*01>3'_IGHJ5*01 | 2627 | A26_IGKJ1*01 | 811 | 1416 |
| 1680 VH3-23_IGHD5-18*01 (2) >1'_IGHJ5*01 | 2628 | A26_IGKJ1*01 | 811 | 1416 |
| 1681 VH3-23_IGHD5-18*01 (2) >3'_IGHJ5*01 | 2629 | A26_IGKJ1*01 | 811 | 1416 |
| 1682 VH3-23_IGHD5-24*01>1'_IGHJ5*01 | 2630 | A26_IGKJ1*01 | 811 | 1416 |
| 1683 VH3-23_IGHD5-24*01>3'_IGHJ5*01 | 2631 | A26_IGKJ1*01 | 811 | 1416 |
| 1684 VH3-23_IGHD6-6*01>1'_IGHJ5*01 | 2632 | A26_IGKJ1*01 | 811 | 1416 |
| 1685 VH3-23_IGHD6-6*01>2'_IGHJ5*01 | 2633 | A26_IGKJ1*01 | 811 | 1416 |
| 1686 VH3-23_IGHD6-6*01>3'_IGHJ5*01 | 2634 | A26_IGKJ1*01 | 811 | 1416 |
| 1687 VH3-23_IGHD1-1*01>1_IGHJ5*01 | 2530 | A14_IGKJ1*01 | 806 | 1411 |
| 1688 VH3-23_IGHD1-1*01>2_IGHJ5*01 | 2531 | A14_IGKJ1*01 | 806 | 1411 |
| 1689 VH3-23_IGHD1-1*01>3_IGHJ5*01 | 2532 | A14_IGKJ1*01 | 806 | 1411 |
| 1690 VH3-23_IGHD1-7*01>1_IGHJ5*01 | 2533 | A14_IGKJ1*01 | 806 | 1411 |
| 1691 VH3-23_IGHD1-7*01>3_IGHJ5*01 | 2534 | A14_IGKJ1*01 | 806 | 1411 |
| 1692 VH3-23_IGHD1-14*01>1_IGHJ5*01 | 2535 | A14_IGKJ1*01 | 806 | 1411 |
| 1693 VH3-23_IGHD1-14*01>3_IGHJ5*01 | 2536 | A14_IGKJ1*01 | 806 | 1411 |
| 1694 VH3-23_IGHD1-20*01>1_IGHJ5*01 | 2537 | A14_IGKJ1*01 | 806 | 1411 |
| 1695 VH3-23_IGHD1-20*01>3_IGHJ5*01 | 2538 | A14_IGKJ1*01 | 806 | 1411 |
| 1696 VH3-23_IGHD1-26*01>1_IGHJ5*01 | 2539 | A14_IGKJ1*01 | 806 | 1411 |
| 1697 VH3-23_IGHD1-26*01>3_IGHJ5*01 | 2540 | A14_IGKJ1*01 | 806 | 1411 |
| 1698 VH3-23_IGHD2-2*01>2_IGHJ5*01 | 2541 | A14_IGKJ1*01 | 806 | 1411 |
| 1699 VH3-23_IGHD2-2*01>3_IGHJ5*01 | 2542 | A14_IGKJ1*01 | 806 | 1411 |
| 1700 VH3-23_IGHD2-8*01>2_IGHJ5*01 | 2543 | A14_IGKJ1*01 | 806 | 1411 |
| 1701 VH3-23_IGHD2-8*01>3_IGHJ5*01 | 2544 | A14_IGKJ1*01 | 806 | 1411 |
| 1702 VH3-23_IGHD2-15*01>2_IGHJ5*01 | 2545 | A14_IGKJ1*01 | 806 | 1411 |
| 1703 VH3-23_IGHD2-15*01>3_IGHJ5*01 | 2546 | A14_IGKJ1*01 | 806 | 1411 |
| 1704 VH3-23_IGHD2-21*01>2_IGHJ5*01 | 2547 | A14_IGKJ1*01 | 806 | 1411 |
| 1705 VH3-23_IGHD2-21*01>3_IGHJ5*01 | 2548 | A14_IGKJ1*01 | 806 | 1411 |
| 1706 VH3-23_IGHD3-3*01>1_IGHJ5*01 | 2549 | A14_IGKJ1*01 | 806 | 1411 |
| 1707 VH3-23_IGHD3-3*01>2_IGHJ5*01 | 2550 | A14_IGKJ1*01 | 806 | 1411 |
| 1708 VH3-23_IGHD3-3*01>3_IGHJ5*01 | 2551 | A14_IGKJ1*01 | 806 | 1411 |
| 1709 VH3-23_IGHD3-9*01>2_IGHJ5*01 | 2552 | A14_IGKJ1*01 | 806 | 1411 |
| 1710 VH3-23_IGHD3-10*01>2_IGHJ5*01 | 2553 | A14_IGKJ1*01 | 806 | 1411 |
| 1711 VH3-23_IGHD3-10*01>3_IGHJ5*01 | 2554 | A14_IGKJ1*01 | 806 | 1411 |
| 1712 VH3-23_IGHD3-16*01>2_IGHJ5*01 | 2555 | A14_IGKJ1*01 | 806 | 1411 |
| 1713 VH3-23_IGHD3-16*01>3_IGHJ5*01 | 2556 | A14_IGKJ1*01 | 806 | 1411 |
| 1714 VH3-23_IGHD3-22*01>2_IGHJ5*01 | 2557 | A14_IGKJ1*01 | 806 | 1411 |
| 1715 VH3-23_IGHD3-22*01>3_IGHJ5*01 | 2558 | A14_IGKJ1*01 | 806 | 1411 |
| 1716 VH3-23_IGHD4-4*01 (1) >2_IGHJ5*01 | 2559 | A14_IGKJ1*01 | 806 | 1411 |
| 1717 VH3-23_IGHD4-4*01 (1) >3_IGHJ5*01 | 2560 | A14_IGKJ1*01 | 806 | 1411 |
| 1718 VH3-23_IGHD4-11*01 (1) >2_IGHJ5*01 | 2561 | A14_IGKJ1*01 | 806 | 1411 |
| 1719 VH3-23_IGHD4-11*01 (1) >3_IGHJ5*01 | 2562 | A14_IGKJ1*01 | 806 | 1411 |
| 1720 VH3-23_IGHD4-17*01>2_IGHJ5*01 | 2563 | A14_IGKJ1*01 | 806 | 1411 |
| 1721 VH3-23_IGHD4-17*01>3_IGHJ5*01 | 2564 | A14_IGKJ1*01 | 806 | 1411 |
| 1722 VH3-23_IGHD4-23*01>2_IGHJ5*01 | 2565 | A14_IGKJ1*01 | 806 | 1411 |
| 1723 VH3-23_IGHD4-23*01>3_IGHJ5*01 | 2566 | A14_IGKJ1*01 | 806 | 1411 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 1724 | VH3-23_IGHD5-5*01 (2) >1_IGHJ5*01 | 2567 | A14_IGKJ1*01 | 806 | 1411 |
| 1725 | VH3-23_IGHD5-5*01 (2) >2_IGHJ5*01 | 2568 | A14_IGKJ1*01 | 806 | 1411 |
| 1726 | VH3-23_IGHD5-5*01 (2) >3_IGHJ5*01 | 2569 | A14_IGKJ1*01 | 806 | 1411 |
| 1727 | VH3-23_IGHD5-12*01>1_IGHJ5*01 | 2570 | A14_IGKJ1*01 | 806 | 1411 |
| 1728 | VH3-23_IGHD5-12*01>3_IGHJ5*01 | 2571 | A14_IGKJ1*01 | 806 | 1411 |
| 1729 | VH3-23_IGHD5-18*01 (2) >1_IGHJ5*01 | 2572 | A14_IGKJ1*01 | 806 | 1411 |
| 1730 | VH3-23_IGHD5-18*01 (2) >2_IGHJ5*01 | 2573 | A14_IGKJ1*01 | 806 | 1411 |
| 1731 | VH3-23_IGHD5-18*01 (2) >3_IGHJ5*01 | 2574 | A14_IGKJ1*01 | 806 | 1411 |
| 1732 | VH3-23_IGHD5-24*01>1_IGHJ5*01 | 2575 | A14_IGKJ1*01 | 806 | 1411 |
| 1733 | VH3-23_IGHD5-24*01>3_IGHJ5*01 | 2576 | A14_IGKJ1*01 | 806 | 1411 |
| 1734 | VH3-23_IGHD6-6*01>1_IGHJ5*01 | 2577 | A14_IGKJ1*01 | 806 | 1411 |
| 1735 | VH3-23_IGHD1-1*01>1'_IGHJ5*01 | 2587 | A14_IGKJ1*01 | 806 | 1411 |
| 1736 | VH3-23_IGHD1-1*01>2'_IGHJ5*01 | 2588 | A14_IGKJ1*01 | 806 | 1411 |
| 1737 | VH3-23_IGHD1-1*01>3'_IGHJ5*01 | 2589 | A14_IGKJ1*01 | 806 | 1411 |
| 1738 | VH3-23_IGHD1-7*01>1'_IGHJ5*01 | 2590 | A14_IGKJ1*01 | 806 | 1411 |
| 1739 | VH3-23_IGHD1-7*01>3'_IGHJ5*01 | 2591 | A14_IGKJ1*01 | 806 | 1411 |
| 1740 | VH3-23_IGHD1-14*01>1'_IGHJ5*01 | 2592 | A14_IGKJ1*01 | 806 | 1411 |
| 1741 | VH3-23_IGHD1-14*01>2'_IGHJ5*01 | 2593 | A14_IGKJ1*01 | 806 | 1411 |
| 1742 | VH3-23_IGHD1-14*01>3'_IGHJ5*01 | 2594 | A14_IGKJ1*01 | 806 | 1411 |
| 1743 | VH3-23_IGHD1-20*01>1'_IGHJ5*01 | 2595 | A14_IGKJ1*01 | 806 | 1411 |
| 1744 | VH3-23_IGHD1-20*01>2'_IGHJ5*01 | 2596 | A14_IGKJ1*01 | 806 | 1411 |
| 1745 | VH3-23_IGHD1-20*01>3'_IGHJ5*01 | 2597 | A14_IGKJ1*01 | 806 | 1411 |
| 1746 | VH3-23_IGHD1-26*01>1'_IGHJ5*01 | 2598 | A14_IGKJ1*01 | 806 | 1411 |
| 1747 | VH3-23_IGHD1-26*01>3'_IGHJ5*01 | 2599 | A14_IGKJ1*01 | 806 | 1411 |
| 1748 | VH3-23_IGHD2-2*01>1'_IGHJ5*01 | 2600 | A14_IGKJ1*01 | 806 | 1411 |
| 1749 | VH3-23_IGHD2-2*01>3'_IGHJ5*01 | 2601 | A14_IGKJ1*01 | 806 | 1411 |
| 1750 | VH3-23_IGHD2-8*01>1'_IGHJ5*01 | 2602 | A14_IGKJ1*01 | 806 | 1411 |
| 1751 | VH3-23_IGHD2-15*01>1'_IGHJ5*01 | 2603 | A14_IGKJ1*01 | 806 | 1411 |
| 1752 | VH3-23_IGHD2-15*01>3'_IGHJ5*01 | 2604 | A14_IGKJ1*01 | 806 | 1411 |
| 1753 | VH3-23_IGHD2-21*01>1'_IGHJ5*01 | 2605 | A14_IGKJ1*01 | 806 | 1411 |
| 1754 | VH3-23_IGHD2-21*01>3'_IGHJ5*01 | 2606 | A14_IGKJ1*01 | 806 | 1411 |
| 1755 | VH3-23_IGHD3-3*01>1'_IGHJ5*01 | 2607 | A14_IGKJ1*01 | 806 | 1411 |
| 1756 | VH3-23_IGHD3-3*01>3'_IGHJ5*01 | 2608 | A14_IGKJ1*01 | 806 | 1411 |
| 1757 | VH3-23_IGHD3-9*01>1'_IGHJ5*01 | 2609 | A14_IGKJ1*01 | 806 | 1411 |
| 1758 | VH3-23_IGHD3-9*01>3'_IGHJ5*01 | 2610 | A14_IGKJ1*01 | 806 | 1411 |
| 1759 | VH3-23_IGHD3-10*01>1'_IGHJ5*01 | 2611 | A14_IGKJ1*01 | 806 | 1411 |
| 1760 | VH3-23_IGHD3-10*01>3'_IGHJ5*01 | 2612 | A14_IGKJ1*01 | 806 | 1411 |
| 1761 | VH3-23_IGHD3-16*01>1'_IGHJ5*01 | 2613 | A14_IGKJ1*01 | 806 | 1411 |
| 1762 | VH3-23_IGHD3-16*01>3'_IGHJ5*01 | 2614 | A14_IGKJ1*01 | 806 | 1411 |
| 1763 | VH3-23_IGHD3-22*01>1'_IGHJ5*01 | 2615 | A14_IGKJ1*01 | 806 | 1411 |
| 1764 | VH3-23_IGHD4-4*01 (1) >1'_IGHJ5*01 | 2616 | A14_IGKJ1*01 | 806 | 1411 |
| 1765 | VH3-23_IGHD4-4*01 (1) >3'_IGHJ5*01 | 2617 | A14_IGKJ1*01 | 806 | 1411 |
| 1766 | VH3-23_IGHD4-11*01 (1) >1'_IGHJ5*01 | 2618 | A14_IGKJ1*01 | 806 | 1411 |
| 1767 | VH3-23_IGHD4-11*01 (1) >3'_IGHJ5*01 | 2619 | A14_IGKJ1*01 | 806 | 1411 |
| 1768 | VH3-23_IGHD4-17*01>1'_IGHJ5*01 | 2620 | A14_IGKJ1*01 | 806 | 1411 |
| 1769 | VH3-23_IGHD4-17*01>3'_IGHJ5*01 | 2621 | A14_IGKJ1*01 | 806 | 1411 |
| 1770 | VH3-23_IGHD4-23*01>1'_IGHJ5*01 | 2622 | A14_IGKJ1*01 | 806 | 1411 |
| 1771 | VH3-23_IGHD4-23*01>3'_IGHJ5*01 | 2623 | A14_IGKJ1*01 | 806 | 1411 |
| 1772 | VH3-23_IGHD5-5*01 (2) >1'_IGHJ5*01 | 2624 | A14_IGKJ1*01 | 806 | 1411 |
| 1773 | VH3-23_IGHD5-5*01 (2) >3'_IGHJ5*01 | 2625 | A14_IGKJ1*01 | 806 | 1411 |
| 1774 | VH3-23_IGHD5-12*01>1'_IGHJ5*01 | 2626 | A14_IGKJ1*01 | 806 | 1411 |
| 1775 | VH3-23_IGHD5-12*01>3'_IGHJ5*01 | 2627 | A14_IGKJ1*01 | 806 | 1411 |
| 1776 | VH3-23_IGHD5-18*01 (2) >1'_IGHJ5*01 | 2628 | A14_IGKJ1*01 | 806 | 1411 |
| 1777 | VH3-23_IGHD5-18*01 (2) >3'_IGHJ5*01 | 2629 | A14_IGKJ1*01 | 806 | 1411 |
| 1778 | VH3-23_IGHD5-24*01>1'_IGHJ5*01 | 2630 | A14_IGKJ1*01 | 806 | 1411 |
| 1779 | VH3-23_IGHD5-24*01>3'_IGHJ5*01 | 2631 | A14_IGKJ1*01 | 806 | 1411 |
| 1780 | VH3-23_IGHD6-6*01>1'_IGHJ5*01 | 2632 | A14_IGKJ1*01 | 806 | 1411 |
| 1781 | VH3-23_IGHD6-6*01>2'_IGHJ5*01 | 2633 | A14_IGKJ1*01 | 806 | 1411 |
| 1782 | VH3-23_IGHD6-6*01>3'_IGHJ5*01 | 2634 | A14_IGKJ1*01 | 806 | 1411 |
| 1783 | VH3-23_IGHD1-1*01>1_IGHJ5*01 | 2530 | A27_IGKJ1*01 | 812 | 1417 |
| 1784 | VH3-23_IGHD1-1*01>2_IGHJ5*01 | 2531 | A27_IGKJ1*01 | 812 | 1417 |
| 1785 | VH3-23_IGHD1-1*01>3_IGHJ5*01 | 2532 | A27_IGKJ1*01 | 812 | 1417 |
| 1786 | VH3-23_IGHD1-7*01>1_IGHJ5*01 | 2533 | A27_IGKJ1*01 | 812 | 1417 |
| 1787 | VH3-23_IGHD1-7*01>3_IGHJ5*01 | 2534 | A27_IGKJ1*01 | 812 | 1417 |
| 1788 | VH3-23_IGHD1-14*01>1_IGHJ5*01 | 2535 | A27_IGKJ1*01 | 812 | 1417 |
| 1789 | VH3-23_IGHD1-14*01>3_IGHJ5*01 | 2536 | A27_IGKJ1*01 | 812 | 1417 |
| 1790 | VH3-23_IGHD1-20*01>1_IGHJ5*01 | 2537 | A27_IGKJ1*01 | 812 | 1417 |
| 1791 | VH3-23_IGHD1-20*01>3_IGHJ5*01 | 2538 | A27_IGKJ1*01 | 812 | 1417 |
| 1792 | VH3-23_IGHD1-26*01>1_IGHJ5*01 | 2539 | A27_IGKJ1*01 | 812 | 1417 |
| 1793 | VH3-23_IGHD1-26*01>3_IGHJ5*01 | 2540 | A27_IGKJ1*01 | 812 | 1417 |
| 1794 | VH3-23_IGHD2-2*01>2_IGHJ5*01 | 2541 | A27_IGKJ1*01 | 812 | 1417 |
| 1795 | VH3-23_IGHD2-2*01>3_IGHJ5*01 | 2542 | A27_IGKJ1*01 | 812 | 1417 |
| 1796 | VH3-23_IGHD2-8*01>2_IGHJ5*01 | 2543 | A27_IGKJ1*01 | 812 | 1417 |

TABLE 17A-continued

Exemplary Nucleic Acid Paired Library

| HEAVY CHAIN Name | RS SEQ ID NO | LIGHT CHAIN Name | RS SEQ ID NO | NO RS SEQ ID NO |
|---|---|---|---|---|
| 1797 VH3-23_IGHD2-8*01>3_IGHJ5*01 | 2544 | A27_IGKJ1*01 | 812 | 1417 |
| 1798 VH3-23_IGHD2-15*01>2_IGHJ5*01 | 2545 | A27_IGKJ1*01 | 812 | 1417 |
| 1799 VH3-23_IGHD2-15*01>3_IGHJ5*01 | 2546 | A27_IGKJ1*01 | 812 | 1417 |
| 1800 VH3-23_IGHD2-21*01>2_IGHJ5*01 | 2547 | A27_IGKJ1*01 | 812 | 1417 |
| 1801 VH3-23_IGHD2-21*01>3_IGHJ5*01 | 2548 | A27_IGKJ1*01 | 812 | 1417 |
| 1802 VH3-23_IGHD3-3*01>1_IGHJ5*01 | 2549 | A27_IGKJ1*01 | 812 | 1417 |
| 1803 VH3-23_IGHD3-3*01>2_IGHJ5*01 | 2550 | A27_IGKJ1*01 | 812 | 1417 |
| 1804 VH3-23_IGHD3-3*01>3_IGHJ5*01 | 2551 | A27_IGKJ1*01 | 812 | 1417 |
| 1805 VH3-23_IGHD3-9*01>2_IGHJ5*01 | 2552 | A27_IGKJ1*01 | 812 | 1417 |
| 1806 VH3-23_IGHD3-10*01>2_IGHJ5*01 | 2553 | A27_IGKJ1*01 | 812 | 1417 |
| 1807 VH3-23_IGHD3-10*01>3_IGHJ5*01 | 2554 | A27_IGKJ1*01 | 812 | 1417 |
| 1808 VH3-23_IGHD3-16*01>2_IGHJ5*01 | 2555 | A27_IGKJ1*01 | 812 | 1417 |
| 1809 VH3-23_IGHD3-16*01>3_IGHJ5*01 | 2556 | A27_IGKJ1*01 | 812 | 1417 |
| 1810 VH3-23_IGHD3-22*01>2_IGHJ5*01 | 2557 | A27_IGKJ1*01 | 812 | 1417 |
| 1811 VH3-23_IGHD3-22*01>3_IGHJ5*01 | 2558 | A27_IGKJ1*01 | 812 | 1417 |
| 1812 VH3-23_IGHD4-4*01 (1) >2_IGHJ5*01 | 2559 | A27_IGKJ1*01 | 812 | 1417 |
| 1813 VH3-23_IGHD4-4*01 (1) >3_IGHJ5*01 | 2560 | A27_IGKJ1*01 | 812 | 1417 |
| 1814 VH3-23_IGHD4-11*01 (1) >2_IGHJ5*01 | 2561 | A27_IGKJ1*01 | 812 | 1417 |
| 1815 VH3-23_IGHD4-11*01 (1) >3_IGHJ5*01 | 2562 | A27_IGKJ1*01 | 812 | 1417 |
| 1816 VH3-23_IGHD4-17*01>2_IGHJ5*01 | 2563 | A27_IGKJ1*01 | 812 | 1417 |
| 1817 VH3-23_IGHD4-17*01>3_IGHJ5*01 | 2564 | A27_IGKJ1*01 | 812 | 1417 |
| 1818 VH3-23_IGHD4-23*01>2_IGHJ5*01 | 2565 | A27_IGKJ1*01 | 812 | 1417 |
| 1819 VH3-23_IGHD4-23*01>3_IGHJ5*01 | 2566 | A27_IGKJ1*01 | 812 | 1417 |
| 1820 VH3-23_IGHD5-5*01 (2) >1_IGHJ5*01 | 2567 | A27_IGKJ1*01 | 812 | 1417 |
| 1821 VH3-23_IGHD5-5*01 (2) >2_IGHJ5*01 | 2568 | A27_IGKJ1*01 | 812 | 1417 |
| 1822 VH3-23_IGHD5-5*01 (2) >3_IGHJ5*01 | 2569 | A27_IGKJ1*01 | 812 | 1417 |
| 1823 VH3-23_IGHD5-12*01>1_IGHJ5*01 | 2570 | A27_IGKJ1*01 | 812 | 1417 |
| 1824 VH3-23_IGHD5-12*01>3_IGHJ5*01 | 2571 | A27_IGKJ1*01 | 812 | 1417 |
| 1825 VH3-23_IGHD5-18*01 (2) >1_IGHJ5*01 | 2572 | A27_IGKJ1*01 | 812 | 1417 |
| 1826 VH3-23_IGHD5-18*01 (2) >2_IGHJ5*01 | 2573 | A27_IGKJ1*01 | 812 | 1417 |
| 1827 VH3-23_IGHD5-18*01 (2) >3_IGHJ5*01 | 2574 | A27_IGKJ1*01 | 812 | 1417 |
| 1828 VH3-23_IGHD5-24*01>1_IGHJ5*01 | 2575 | A27_IGKJ1*01 | 812 | 1417 |
| 1829 VH3-23_IGHD5-24*01>3_IGHJ5*01 | 2576 | A27_IGKJ1*01 | 812 | 1417 |
| 1830 VH3-23_IGHD6-6*01>1_IGHJ5*01 | 2577 | A27_IGKJ1*01 | 812 | 1417 |
| 1831 VH3-23_IGHD1-1*01>1'_IGHJ5*01 | 2587 | A27_IGKJ1*01 | 812 | 1417 |
| 1832 VH3-23_IGHD1-1*01>2'_IGHJ5*01 | 2588 | A27_IGKJ1*01 | 812 | 1417 |
| 1833 VH3-23_IGHD1-1*01>3'_IGHJ5*01 | 2589 | A27_IGKJ1*01 | 812 | 1417 |
| 1834 VH3-23_IGHD1-7*01>1'_IGHJ5*01 | 2590 | A27_IGKJ1*01 | 812 | 1417 |
| 1835 VH3-23_IGHD1-7*01>3'_IGHJ5*01 | 2591 | A27_IGKJ1*01 | 812 | 1417 |
| 1836 VH3-23_IGHD1-14*01>1'_IGHJ5*01 | 2592 | A27_IGKJ1*01 | 812 | 1417 |
| 1837 VH3-23_IGHD1-14*01>2'_IGHJ5*01 | 2593 | A27_IGKJ1*01 | 812 | 1417 |
| 1838 VH3-23_IGHD1-14*01>3'_IGHJ5*01 | 2594 | A27_IGKJ1*01 | 812 | 1417 |
| 1839 VH3-23_IGHD1-20*01>1'_IGHJ5*01 | 2595 | A27_IGKJ1*01 | 812 | 1417 |
| 1840 VH3-23_IGHD1-20*01>2'_IGHJ5*01 | 2596 | A27_IGKJ1*01 | 812 | 1417 |
| 1841 VH3-23_IGHD1-20*01>3'_IGHJ5*01 | 2597 | A27_IGKJ1*01 | 812 | 1417 |
| 1842 VH3-23_IGHD1-26*01>1'_IGHJ5*01 | 2598 | A27_IGKJ1*01 | 812 | 1417 |
| 1843 VH3-23_IGHD1-26*01>3'_IGHJ5*01 | 2599 | A27_IGKJ1*01 | 812 | 1417 |
| 1844 VH3-23_IGHD2-2*01>1'_IGHJ5*01 | 2600 | A27_IGKJ1*01 | 812 | 1417 |
| 1845 VH3-23_IGHD2-2*01>3'_IGHJ5*01 | 2601 | A27_IGKJ1*01 | 812 | 1417 |
| 1846 VH3-23_IGHD2-8*01>1'_IGHJ5*01 | 2602 | A27_IGKJ1*01 | 812 | 1417 |
| 1847 VH3-23_IGHD2-15*01>1'_IGHJ5*01 | 2603 | A27_IGKJ1*01 | 812 | 1417 |
| 1848 VH3-23_IGHD2-15*01>3'_IGHJ5*01 | 2604 | A27_IGKJ1*01 | 812 | 1417 |
| 1849 VH3-23_IGHD2-21*01>1'_IGHJ5*01 | 2605 | A27_IGKJ1*01 | 812 | 1417 |
| 1850 VH3-23_IGHD2-21*01>3'_IGHJ5*01 | 2606 | A27_IGKJ1*01 | 812 | 1417 |
| 1851 VH3-23_IGHD3-3*01>1'_IGHJ5*01 | 2607 | A27_IGKJ1*01 | 812 | 1417 |
| 1852 VH3-23_IGHD3-3*01>3'_IGHJ5*01 | 2608 | A27_IGKJ1*01 | 812 | 1417 |
| 1853 VH3-23_IGHD3-9*01>1'_IGHJ5*01 | 2609 | A27_IGKJ1*01 | 812 | 1417 |
| 1854 VH3-23_IGHD3-9*01>3'_IGHJ5*01 | 2610 | A27_IGKJ1*01 | 812 | 1417 |
| 1855 VH3-23_IGHD3-10*01>1'_IGHJ5*01 | 2611 | A27_IGKJ1*01 | 812 | 1417 |
| 1856 VH3-23_IGHD3-10*01>3'_IGHJ5*01 | 2612 | A27_IGKJ1*01 | 812 | 1417 |
| 1857 VH3-23_IGHD3-16*01>1'_IGHJ5*01 | 2613 | A27_IGKJ1*01 | 812 | 1417 |
| 1858 VH3-23_IGHD3-16*01>3'_IGHJ5*01 | 2614 | A27_IGKJ1*01 | 812 | 1417 |
| 1859 VH3-23_IGHD3-22*01>1'_IGHJ5*01 | 2615 | A27_IGKJ1*01 | 812 | 1417 |
| 1860 VH3-23_IGHD4-4*01 (1) >1'_IGHJ5*01 | 2616 | A27_IGKJ1*01 | 812 | 1417 |
| 1861 VH3-23_IGHD4-4*01 (1) >3'_IGHJ5*01 | 2617 | A27_IGKJ1*01 | 812 | 1417 |
| 1862 VH3-23_IGHD4-11*01 (1) >1'_IGHJ5*01 | 2618 | A27_IGKJ1*01 | 812 | 1417 |
| 1863 VH3-23_IGHD4-11*01 (1) >3'_IGHJ5*01 | 2619 | A27_IGKJ1*01 | 812 | 1417 |
| 1864 VH3-23_IGHD4-17*01>1'_IGHJ5*01 | 2620 | A27_IGKJ1*01 | 812 | 1417 |
| 1865 VH3-23_IGHD4-17*01>3'_IGHJ5*01 | 2621 | A27_IGKJ1*01 | 812 | 1417 |
| 1866 VH3-23_IGHD4-23*01>1'_IGHJ5*01 | 2622 | A27_IGKJ1*01 | 812 | 1417 |
| 1867 VH3-23_IGHD4-23*01>3'_IGHJ5*01 | 2623 | A27_IGKJ1*01 | 812 | 1417 |
| 1868 VH3-23_IGHD5-5*01 (2) >1'_IGHJ5*01 | 2624 | A27_IGKJ1*01 | 812 | 1417 |
| 1869 VH3-23_IGHD5-5*01 (2) >3'_IGHJ5*01 | 2625 | A27_IGKJ1*01 | 812 | 1417 |

TABLE 17A-continued

Exemplary Nucleic Acid Paired Library

| HEAVY CHAIN Name | RS SEQ ID NO | LIGHT CHAIN Name | RS SEQ ID NO | NO RS SEQ ID NO |
|---|---|---|---|---|
| 1870 VH3-23_IGHD5-12*01>1'_IGHJ5*01 | 2626 | A27_IGKJ1*01 | 812 | 1417 |
| 1871 VH3-23_IGHD5-12*01>3'_IGHJ5*01 | 2627 | A27_IGKJ1*01 | 812 | 1417 |
| 1872 VH3-23_IGHD5-18*01 (2) >1'_IGHJ5*01 | 2628 | A27_IGKJ1*01 | 812 | 1417 |
| 1873 VH3-23_IGHD5-18*01 (2) >3'_IGHJ5*01 | 2629 | A27_IGKJ1*01 | 812 | 1417 |
| 1874 VH3-23_IGHD5-24*01>1'_IGHJ5*01 | 2630 | A27_IGKJ1*01 | 812 | 1417 |
| 1875 VH3-23_IGHD5-24*01>3'_IGHJ5*01 | 2631 | A27_IGKJ1*01 | 812 | 1417 |
| 1876 VH3-23_IGHD6-6*01>1'_IGHJ5*01 | 2632 | A27_IGKJ1*01 | 812 | 1417 |
| 1877 VH3-23_IGHD6-6*01>2'_IGHJ5*01 | 2633 | A27_IGKJ1*01 | 812 | 1417 |
| 1878 VH3-23_IGHD6-6*01>3'_IGHJ5*01 | 2634 | A27_IGKJ1*01 | 812 | 1417 |
| 1879 VH3-23_IGHD6-6*01>2_IGHJ1*01 | 2118 | V1-11_IGLJ2*01 | 836 | 1441 |
| 1880 VH3-23_IGHD6-13*01>1_IGHJ1*01 | 2119 | V1-11_IGLJ2*01 | 836 | 1441 |
| 1881 VH3-23_IGHD6-13*01>2_IGHJ1*01 | 2120 | V1-11_IGLJ2*01 | 836 | 1441 |
| 1882 VH3-23_IGHD6-19*01>1_IGHJ1*01 | 2121 | V1-11_IGLJ2*01 | 836 | 1441 |
| 1883 VH3-23_IGHD6-19*01>2_IGHJ1*01 | 2122 | V1-11_IGLJ2*01 | 836 | 1441 |
| 1884 VH3-23_IGHD6-25*01>1_IGHJ1*01 | 2123 | V1-11_IGLJ2*01 | 836 | 1441 |
| 1885 VH3-23_IGHD6-25*01>2_IGHJ1*01 | 2124 | V1-11_IGLJ2*01 | 836 | 1441 |
| 1886 VH3-23_IGHD7-27*01>1_IGHJ1*01 | 2125 | V1-11_IGLJ2*01 | 836 | 1441 |
| 1887 VH3-23_IGHD7-27*01>3_IGHJ1*01 | 2126 | V1-11_IGLJ2*01 | 836 | 1441 |
| 1888 VH3-23_IGHD6-13*01>1'_IGHJ1*01 | 2175 | V1-11_IGLJ2*01 | 836 | 1441 |
| 1889 VH3-23_IGHD6-13*01>2'_IGHJ1*01 | 2176 | V1-11_IGLJ2*01 | 836 | 1441 |
| 1890 VH3-23_IGHD6-13*01>2_IGHJ1*01_B | 2177 | V1-11_IGLJ2*01 | 836 | 1441 |
| 1891 VH3-23_IGHD6-19*01>1'_IGHJ1*01 | 2178 | V1-11_IGLJ2*01 | 836 | 1441 |
| 1892 VH3-23_IGHD6-19*01>2'_IGHJ1*01 | 2179 | V1-11_IGLJ2*01 | 836 | 1441 |
| 1893 VH3-23_IGHD6-19*01>2_IGHJ1*01_B | 2180 | V1-11_IGLJ2*01 | 836 | 1441 |
| 1894 VH3-23_IGHD6-25*01>1'_IGHJ1*01 | 2181 | V1-11_IGLJ2*01 | 836 | 1441 |
| 1895 VH3-23_IGHD6-25*01>3'_IGHJ1*01 | 2182 | V1-11_IGLJ2*01 | 836 | 1441 |
| 1896 VH3-23_IGHD7-27*01>1'_IGHJ1*01_B | 2183 | V1-11_IGLJ2*01 | 836 | 1441 |
| 1897 VH3-23_IGHD7-27*01>2'_IGHJ1*01 | 2184 | V1-11_IGLJ2*01 | 836 | 1441 |
| 1898 VH3-23_IGHD6-6*01>2_IGHJ2*01 | 2233 | V1-11_IGLJ2*01 | 836 | 1441 |
| 1899 VH3-23_IGHD6-13*01>1_IGHJ2*01 | 2234 | V1-11_IGLJ2*01 | 836 | 1441 |
| 1900 VH3-23_IGHD6-13*01>2_IGHJ2*01 | 2235 | V1-11_IGLJ2*01 | 836 | 1441 |
| 1901 VH3-23_IGHD6-19*01>1_IGHJ2*01 | 2236 | V1-11_IGLJ2*01 | 836 | 1441 |
| 1902 VH3-23_IGHD6-19*01>2_IGHJ2*01 | 2237 | V1-11_IGLJ2*01 | 836 | 1441 |
| 1903 VH3-23_IGHD6-25*01>1_IGHJ2*01 | 2238 | V1-11_IGLJ2*01 | 836 | 1441 |
| 1904 VH3-23_IGHD6-25*01>2_IGHJ2*01 | 2239 | V1-11_IGLJ2*01 | 836 | 1441 |
| 1905 VH3-23_IGHD7-27*01>1_IGHJ2*01 | 2240 | V1-11_IGLJ2*01 | 836 | 1441 |
| 1906 VH3-23_IGHD7-27*01>3_IGHJ2*01 | 2241 | V1-11_IGLJ2*01 | 836 | 1441 |
| 1907 VH3-23_IGHD6-13*01>1'_IGHJ2*01 | 2290 | V1-11_IGLJ2*01 | 836 | 1441 |
| 1908 VH3-23_IGHD6-13*01>2'_IGHJ2*01 | 2291 | V1-11_IGLJ2*01 | 836 | 1441 |
| 1909 VH3-23_IGHD6-13*01>2_IGHJ2*01_B | 2292 | V1-11_IGLJ2*01 | 836 | 1441 |
| 1910 VH3-23_IGHD6-19*01>1'_IGHJ2*01 | 2293 | V1-11_IGLJ2*01 | 836 | 1441 |
| 1911 VH3-23_IGHD6-19*01>2'_IGHJ2*01 | 2294 | V1-11_IGLJ2*01 | 836 | 1441 |
| 1912 VH3-23_IGHD6-19*01>2_IGHJ2*01_B | 2295 | V1-11_IGLJ2*01 | 836 | 1441 |
| 1913 VH3-23_IGHD6-25*01>1'_IGHJ2*01 | 2296 | V1-11_IGLJ2*01 | 836 | 1441 |
| 1914 VH3-23_IGHD6-25*01>3'_IGHJ2*01 | 2297 | V1-11_IGLJ2*01 | 836 | 1441 |
| 1915 VH3-23_IGHD7-27*01>1'_IGHJ2*01 | 2298 | V1-11_IGLJ2*01 | 836 | 1441 |
| 1916 VH3-23_IGHD7-27*01>2'_IGHJ2*01 | 2299 | V1-11_IGLJ2*01 | 836 | 1441 |
| 1917 VH3-23_IGHD6-6*01>2_IGHJ3*01 | 2348 | V1-11_IGLJ2*01 | 836 | 1441 |
| 1918 VH3-23_IGHD6-13*01>1_IGHJ3*01 | 2349 | V1-11_IGLJ2*01 | 836 | 1441 |
| 1919 VH3-23_IGHD6-13*01>2_IGHJ3*01 | 2350 | V1-11_IGLJ2*01 | 836 | 1441 |
| 1920 VH3-23_IGHD6-19*01>1_IGHJ3*01 | 2351 | V1-11_IGLJ2*01 | 836 | 1441 |
| 1921 VH3-23_IGHD6-19*01>2_IGHJ3*01 | 2352 | V1-11_IGLJ2*01 | 836 | 1441 |
| 1922 VH3-23_IGHD6-25*01>1_IGHJ3*01 | 2353 | V1-11_IGLJ2*01 | 836 | 1441 |
| 1923 VH3-23_IGHD6-25*01>2_IGHJ3*01 | 2354 | V1-11_IGLJ2*01 | 836 | 1441 |
| 1924 VH3-23_IGHD7-27*01>1_IGHJ3*01 | 2355 | V1-11_IGLJ2*01 | 836 | 1441 |
| 1925 VH3-23_IGHD7-27*01>3_IGHJ3*01 | 2356 | V1-11_IGLJ2*01 | 836 | 1441 |
| 1926 VH3-23_IGHD6-13*01>1'_IGHJ3*01 | 2405 | V1-11_IGLJ2*01 | 836 | 1441 |
| 1927 VH3-23_IGHD6-13*01>2'_IGHJ3*01 | 2406 | V1-11_IGLJ2*01 | 836 | 1441 |
| 1928 VH3-23_IGHD6-13*01>1_IGHJ6*01 | 2407 | V1-11_IGLJ2*01 | 836 | 1441 |
| 1929 VH3-23_IGHD6-19*01>1'_IGHJ3*01 | 2408 | V1-11_IGLJ2*01 | 836 | 1441 |
| 1930 VH3-23_IGHD6-19*01>2'_IGHJ3*01 | 2409 | V1-11_IGLJ2*01 | 836 | 1441 |
| 1931 VH3-23_IGHD6-19*01>3'_IGHJ3*01 | 2410 | V1-11_IGLJ2*01 | 836 | 1441 |
| 1932 VH3-23_IGHD6-25*01>1'_IGHJ3*01 | 2411 | V1-11_IGLJ2*01 | 836 | 1441 |
| 1933 VH3-23_IGHD6-25*01>3'_IGHJ3*01 | 2412 | V1-11_IGLJ2*01 | 836 | 1441 |
| 1934 VH3-23_IGHD7-27*01>1'_IGHJ3*01 | 2413 | V1-11_IGLJ2*01 | 836 | 1441 |
| 1935 VH3-23_IGHD7-27*01>2'_IGHJ3*01 | 2414 | V1-11_IGLJ2*01 | 836 | 1441 |
| 1936 VH3-23_IGHD6-6*01>2_IGHJ4*01 | 2463 | V1-11_IGLJ2*01 | 836 | 1441 |
| 1937 VH3-23_IGHD6-13*01>1_IGHJ4*01 | 2464 | V1-11_IGLJ2*01 | 836 | 1441 |
| 1938 VH3-23_IGHD6-13*01>2_IGHJ4*01 | 2465 | V1-11_IGLJ2*01 | 836 | 1441 |
| 1939 VH3-23_IGHD6-19*01>1_IGHJ4*01 | 2466 | V1-11_IGLJ2*01 | 836 | 1441 |
| 1940 VH3-23_IGHD6-19*01>2_IGHJ4*01 | 2467 | V1-11_IGLJ2*01 | 836 | 1441 |
| 1941 VH3-23_IGHD6-25*01>1_IGHJ4*01 | 2468 | V1-11_IGLJ2*01 | 836 | 1441 |
| 1942 VH3-23_IGHD6-25*01>2_IGHJ4*01 | 2469 | V1-11_IGLJ2*01 | 836 | 1441 |

TABLE 17A-continued

Exemplary Nucleic Acid Paired Library

| HEAVY CHAIN Name | RS SEQ ID NO | LIGHT CHAIN Name | RS SEQ ID NO | NO RS SEQ ID NO |
|---|---|---|---|---|
| 1943 VH3-23_IGHD7-27*01>1_IGHJ4*01 | 2470 | V1-11_IGLJ2*01 | 836 | 1441 |
| 1944 VH3-23_IGHD7-27*01>3_IGHJ4*01 | 2471 | V1-11_IGLJ2*01 | 836 | 1441 |
| 1945 VH3-23_IGHD6-13*01>1'_IGHJ4*01 | 2520 | V1-11_IGLJ2*01 | 836 | 1441 |
| 1946 VH3-23_IGHD6-13*01>2'_IGHJ4*01 | 2521 | V1-11_IGLJ2*01 | 836 | 1441 |
| 1947 VH3-23_IGHD6-13*01>2_IGHJ4*01_B | 2522 | V1-11_IGLJ2*01 | 836 | 1441 |
| 1948 VH3-23_IGHD6-19*01>1'_IGHJ4*01 | 2523 | V1-11_IGLJ2*01 | 836 | 1441 |
| 1949 VH3-23_IGHD6-19*01>2'_IGHJ4*01 | 2524 | V1-11_IGLJ2*01 | 836 | 1441 |
| 1950 VH3-23_IGHD6-19*01>2_IGHJ4*01_B | 2525 | V1-11_IGLJ2*01 | 836 | 1441 |
| 1951 VH3-23_IGHD6-25*01>1'_IGHJ4*01 | 2526 | V1-11_IGLJ2*01 | 836 | 1441 |
| 1952 VH3-23_IGHD6-25*01>3'_IGHJ4*01 | 2527 | V1-11_IGLJ2*01 | 836 | 1441 |
| 1953 VH3-23_IGHD7-27*01>1'_IGHJ4*01 | 2528 | V1-11_IGLJ2*01 | 836 | 1441 |
| 1954 VH3-23_IGHD7-27*01>2'_IGHJ4*01 | 2529 | V1-11_IGLJ2*01 | 836 | 1441 |
| 1955 VH3-23_IGHD6-6*01>2_IGHJ5*01 | 2578 | V1-11_IGLJ2*01 | 836 | 1441 |
| 1956 VH3-23_IGHD6-13*01>1_IGHJ5*01 | 2579 | V1-11_IGLJ2*01 | 836 | 1441 |
| 1957 VH3-23_IGHD6-13*01>2_IGHJ5*01 | 2580 | V1-11_IGLJ2*01 | 836 | 1441 |
| 1958 VH3-23_IGHD6-19*01>1_IGHJ5*01 | 2581 | V1-11_IGLJ2*01 | 836 | 1441 |
| 1959 VH3-23_IGHD6-19*01>2_IGHJ5*01 | 2582 | V1-11_IGLJ2*01 | 836 | 1441 |
| 1960 VH3-23_IGHD6-25*01>1_IGHJ5*01 | 2583 | V1-11_IGLJ2*01 | 836 | 1441 |
| 1961 VH3-23_IGHD6-25*01>2_IGHJ5*01 | 2584 | V1-11_IGLJ2*01 | 836 | 1441 |
| 1962 VH3-23_IGHD7-27*01>1_IGHJ5*01 | 2585 | V1-11_IGLJ2*01 | 836 | 1441 |
| 1963 VH3-23_IGHD7-27*01>3_IGHJ5*01 | 2586 | V1-11_IGLJ2*01 | 836 | 1441 |
| 1964 VH3-23_IGHD6-13*01>1'_IGHJ5*01 | 2635 | V1-11_IGLJ2*01 | 836 | 1441 |
| 1965 VH3-23_IGHD6-13*01>2'_IGHJ5*01 | 2636 | V1-11_IGLJ2*01 | 836 | 1441 |
| 1966 VH3-23_IGHD6-13*01>3'_IGHJ5*01 | 2637 | V1-11_IGLJ2*01 | 836 | 1441 |
| 1967 VH3-23_IGHD6-19*01>1'_IGHJ5*01 | 2638 | V1-11_IGLJ2*01 | 836 | 1441 |
| 1968 VH3-23_IGHD6-19*01>2'_IGHJ5*01 | 2639 | V1-11_IGLJ2*01 | 836 | 1441 |
| 1969 VH3-23_IGHD6-19*01>2_IGHJ5*01_B | 2640 | V1-11_IGLJ2*01 | 836 | 1441 |
| 1970 VH3-23_IGHD6-25*01>1'_IGHJ5*01 | 2641 | V1-11_IGLJ2*01 | 836 | 1441 |
| 1971 VH3-23_IGHD6-25*01>3'_IGHJ5*01 | 2642 | V1-11_IGLJ2*01 | 836 | 1441 |
| 1972 VH3-23_IGHD7-27*01>1'_IGHJ5*01 | 2643 | V1-11_IGLJ2*01 | 836 | 1441 |
| 1973 VH3-23_IGHD7-27*01>2'_IGHJ5*01 | 2644 | V1-11_IGLJ2*01 | 836 | 1441 |
| 1974 VH3-23_IGHD6-6*01>2_IGHJ6*01 | 2693 | V1-11_IGLJ2*01 | 836 | 1441 |
| 1975 VH3-23_IGHD6-6*01>2_IGHJ1*01 | 2118 | V1-13_IGLJ5*01 | 837 | 1442 |
| 1976 VH3-23_IGHD6-13*01>1_IGHJ1*01 | 2119 | V1-13_IGLJ5*01 | 837 | 1442 |
| 1977 VH3-23_IGHD6-13*01>2_IGHJ1*01 | 2120 | V1-13_IGLJ5*01 | 837 | 1442 |
| 1978 VH3-23_IGHD6-19*01>1_IGHJ1*01 | 2121 | V1-13_IGLJ5*01 | 837 | 1442 |
| 1979 VH3-23_IGHD6-19*01>2_IGHJ1*01 | 2122 | V1-13_IGLJ5*01 | 837 | 1442 |
| 1980 VH3-23_IGHD6-25*01>1_IGHJ1*01 | 2123 | V1-13_IGLJ5*01 | 837 | 1442 |
| 1981 VH3-23_IGHD6-25*01>2_IGHJ1*01 | 2124 | V1-13_IGLJ5*01 | 837 | 1442 |
| 1982 VH3-23_IGHD7-27*01>1_IGHJ1*01 | 2125 | V1-13_IGLJ5*01 | 837 | 1442 |
| 1983 VH3-23_IGHD7-27*01>3_IGHJ1*01 | 2126 | V1-13_IGLJ5*01 | 837 | 1442 |
| 1984 VH3-23_IGHD6-13*01>1'_IGHJ1*01 | 2175 | V1-13_IGLJ5*01 | 837 | 1442 |
| 1985 VH3-23_IGHD6-13*01>2'_IGHJ1*01 | 2176 | V1-13_IGLJ5*01 | 837 | 1442 |
| 1986 VH3-23_IGHD6-13*01>2_IGHJ1*01_B | 2177 | V1-13_IGLJ5*01 | 837 | 1442 |
| 1987 VH3-23_IGHD6-19*01>1'_IGHJ1*01 | 2178 | V1-13_IGLJ5*01 | 837 | 1442 |
| 1988 VH3-23_IGHD6-19*01>2'_IGHJ1*01 | 2179 | V1-13_IGLJ5*01 | 837 | 1442 |
| 1989 VH3-23_IGHD6-19*01>2_IGHJ1*01_B | 2180 | V1-13_IGLJ5*01 | 837 | 1442 |
| 1990 VH3-23_IGHD6-25*01>1'_IGHJ1*01 | 2181 | V1-13_IGLJ5*01 | 837 | 1442 |
| 1991 VH3-23_IGHD6-25*01>3'_IGHJ1*01 | 2182 | V1-13_IGLJ5*01 | 837 | 1442 |
| 1992 VH3-23_IGHD7-27*01>1'_IGHJ1*01_B | 2183 | V1-13_IGLJ5*01 | 837 | 1442 |
| 1993 VH3-23_IGHD7-27*01>2'_IGHJ1*01 | 2184 | V1-13_IGLJ5*01 | 837 | 1442 |
| 1994 VH3-23_IGHD6-6*01>2_IGHJ2*01 | 2233 | V1-13_IGLJ5*01 | 837 | 1442 |
| 1995 VH3-23_IGHD6-13*01>1_IGHJ2*01 | 2234 | V1-13_IGLJ5*01 | 837 | 1442 |
| 1996 VH3-23_IGHD6-13*01>2_IGHJ2*01 | 2235 | V1-13_IGLJ5*01 | 837 | 1442 |
| 1997 VH3-23_IGHD6-19*01>1_IGHJ2*01 | 2236 | V1-13_IGLJ5*01 | 837 | 1442 |
| 1998 VH3-23_IGHD6-19*01>2_IGHJ2*01 | 2237 | V1-13_IGLJ5*01 | 837 | 1442 |
| 1999 VH3-23_IGHD6-25*01>1_IGHJ2*01 | 2238 | V1-13_IGLJ5*01 | 837 | 1442 |
| 2000 VH3-23_IGHD6-25*01>2_IGHJ2*01 | 2239 | V1-13_IGLJ5*01 | 837 | 1442 |
| 2001 VH3-23_IGHD7-27*01>1_IGHJ2*01 | 2240 | V1-13_IGLJ5*01 | 837 | 1442 |
| 2002 VH3-23_IGHD7-27*01>3_IGHJ2*01 | 2241 | V1-13_IGLJ5*01 | 837 | 1442 |
| 2003 VH3-23_IGHD6-13*01>1'_IGHJ2*01 | 2290 | V1-13_IGLJ5*01 | 837 | 1442 |
| 2004 VH3-23_IGHD6-13*01>2'_IGHJ2*01 | 2291 | V1-13_IGLJ5*01 | 837 | 1442 |
| 2005 VH3-23_IGHD6-13*01>2_IGHJ2*01_B | 2292 | V1-13_IGLJ5*01 | 837 | 1442 |
| 2006 VH3-23_IGHD6-19*01>1'_IGHJ2*01 | 2293 | V1-13_IGLJ5*01 | 837 | 1442 |
| 2007 VH3-23_IGHD6-19*01>2'_IGHJ2*01 | 2294 | V1-13_IGLJ5*01 | 837 | 1442 |
| 2008 VH3-23_IGHD6-19*01>2_IGHJ2*01_B | 2295 | V1-13_IGLJ5*01 | 837 | 1442 |
| 2009 VH3-23_IGHD6-25*01>1'_IGHJ2*01 | 2296 | V1-13_IGLJ5*01 | 837 | 1442 |
| 2010 VH3-23_IGHD6-25*01>3'_IGHJ2*01 | 2297 | V1-13_IGLJ5*01 | 837 | 1442 |
| 2011 VH3-23_IGHD7-27*01>1'_IGHJ2*01 | 2298 | V1-13_IGLJ5*01 | 837 | 1442 |
| 2012 VH3-23_IGHD7-27*01>2'_IGHJ2*01 | 2299 | V1-13_IGLJ5*01 | 837 | 1442 |
| 2013 VH3-23_IGHD6-6*01>2_IGHJ3*01 | 2348 | V1-13_IGLJ5*01 | 837 | 1442 |
| 2014 VH3-23_IGHD6-13*01>1_IGHJ3*01 | 2349 | V1-13_IGLJ5*01 | 837 | 1442 |
| 2015 VH3-23_IGHD6-13*01>2_IGHJ3*01 | 2350 | V1-13_IGLJ5*01 | 837 | 1442 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 2016 | VH3-23_IGHD6-19*01>1_IGHJ3*01 | 2351 | V1-13_IGLJ5*01 | 837 | 1442 |
| 2017 | VH3-23_IGHD6-19*01>2_IGHJ3*01 | 2352 | V1-13_IGLJ5*01 | 837 | 1442 |
| 2018 | VH3-23_IGHD6-25*01>1_IGHJ3*01 | 2353 | V1-13_IGLJ5*01 | 837 | 1442 |
| 2019 | VH3-23_IGHD6-25*01>2_IGHJ3*01 | 2354 | V1-13_IGLJ5*01 | 837 | 1442 |
| 2020 | VH3-23_IGHD7-27*01>1_IGHJ3*01 | 2355 | V1-13_IGLJ5*01 | 837 | 1442 |
| 2021 | VH3-23_IGHD7-27*01>3_IGHJ3*01 | 2356 | V1-13_IGLJ5*01 | 837 | 1442 |
| 2022 | VH3-23_IGHD6-13*01>1'_IGHJ3*01 | 2405 | V1-13_IGLJ5*01 | 837 | 1442 |
| 2023 | VH3-23_IGHD6-13*01>2'_IGHJ3*01 | 2406 | V1-13_IGLJ5*01 | 837 | 1442 |
| 2024 | VH3-23_IGHD6-13*01>1_IGHJ6*01 | 2407 | V1-13_IGLJ5*01 | 837 | 1442 |
| 2025 | VH3-23_IGHD6-19*01>1'_IGHJ3*01 | 2408 | V1-13_IGLJ5*01 | 837 | 1442 |
| 2026 | VH3-23_IGHD6-19*01>2'_IGHJ3*01 | 2409 | V1-13_IGLJ5*01 | 837 | 1442 |
| 2027 | VH3-23_IGHD6-19*01>3'_IGHJ3*01 | 2410 | V1-13_IGLJ5*01 | 837 | 1442 |
| 2028 | VH3-23_IGHD6-25*01>1'_IGHJ3*01 | 2411 | V1-13_IGLJ5*01 | 837 | 1442 |
| 2029 | VH3-23_IGHD6-25*01>3'_IGHJ3*01 | 2412 | V1-13_IGLJ5*01 | 837 | 1442 |
| 2030 | VH3-23_IGHD7-27*01>1'_IGHJ3*01 | 2413 | V1-13_IGLJ5*01 | 837 | 1442 |
| 2031 | VH3-23_IGHD7-27*01>2'_IGHJ3*01 | 2414 | V1-13_IGLJ5*01 | 837 | 1442 |
| 2032 | VH3-23_IGHD6-6*01>2_IGHJ4*01 | 2463 | V1-13_IGLJ5*01 | 837 | 1442 |
| 2033 | VH3-23_IGHD6-13*01>1_IGHJ4*01 | 2464 | V1-13_IGLJ5*01 | 837 | 1442 |
| 2034 | VH3-23_IGHD6-13*01>2_IGHJ4*01 | 2465 | V1-13_IGLJ5*01 | 837 | 1442 |
| 2035 | VH3-23_IGHD6-19*01>1_IGHJ4*01 | 2466 | V1-13_IGLJ5*01 | 837 | 1442 |
| 2036 | VH3-23_IGHD6-19*01>2_IGHJ4*01 | 2467 | V1-13_IGLJ5*01 | 837 | 1442 |
| 2037 | VH3-23_IGHD6-25*01>1_IGHJ4*01 | 2468 | V1-13_IGLJ5*01 | 837 | 1442 |
| 2038 | VH3-23_IGHD6-25*01>2_IGHJ4*01 | 2469 | V1-13_IGLJ5*01 | 837 | 1442 |
| 2039 | VH3-23_IGHD7-27*01>1_IGHJ4*01 | 2470 | V1-13_IGLJ5*01 | 837 | 1442 |
| 2040 | VH3-23_IGHD7-27*01>3_IGHJ4*01 | 2471 | V1-13_IGLJ5*01 | 837 | 1442 |
| 2041 | VH3-23_IGHD6-13*01>1'_IGHJ4*01 | 2520 | V1-13_IGLJ5*01 | 837 | 1442 |
| 2042 | VH3-23_IGHD6-13*01>2'_IGHJ4*01 | 2521 | V1-13_IGLJ5*01 | 837 | 1442 |
| 2043 | VH3-23_IGHD6-13*01>2'_IGHJ4*01_B | 2522 | V1-13_IGLJ5*01 | 837 | 1442 |
| 2044 | VH3-23_IGHD6-19*01>1'_IGHJ4*01 | 2523 | V1-13_IGLJ5*01 | 837 | 1442 |
| 2045 | VH3-23_IGHD6-19*01>2'_IGHJ4*01 | 2524 | V1-13_IGLJ5*01 | 837 | 1442 |
| 2046 | VH3-23_IGHD6-19*01>2'_IGHJ4*01_B | 2525 | V1-13_IGLJ5*01 | 837 | 1442 |
| 2047 | VH3-23_IGHD6-25*01>1'_IGHJ4*01 | 2526 | V1-13_IGLJ5*01 | 837 | 1442 |
| 2048 | VH3-23_IGHD6-25*01>3'_IGHJ4*01 | 2527 | V1-13_IGLJ5*01 | 837 | 1442 |
| 2049 | VH3-23_IGHD7-27*01>1'_IGHJ4*01 | 2528 | V1-13_IGLJ5*01 | 837 | 1442 |
| 2050 | VH3-23_IGHD7-27*01>2'_IGHJ4*01 | 2529 | V1-13_IGLJ5*01 | 837 | 1442 |
| 2051 | VH3-23_IGHD6-6*01>2_IGHJ5*01 | 2578 | V1-13_IGLJ5*01 | 837 | 1442 |
| 2052 | VH3-23_IGHD6-13*01>1_IGHJ5*01 | 2579 | V1-13_IGLJ5*01 | 837 | 1442 |
| 2053 | VH3-23_IGHD6-13*01>2_IGHJ5*01 | 2580 | V1-13_IGLJ5*01 | 837 | 1442 |
| 2054 | VH3-23_IGHD6-19*01>1_IGHJ5*01 | 2581 | V1-13_IGLJ5*01 | 837 | 1442 |
| 2055 | VH3-23_IGHD6-19*01>2_IGHJ5*01 | 2582 | V1-13_IGLJ5*01 | 837 | 1442 |
| 2056 | VH3-23_IGHD6-25*01>1_IGHJ5*01 | 2583 | V1-13_IGLJ5*01 | 837 | 1442 |
| 2057 | VH3-23_IGHD6-25*01>2_IGHJ5*01 | 2584 | V1-13_IGLJ5*01 | 837 | 1442 |
| 2058 | VH3-23_IGHD7-27*01>1_IGHJ5*01 | 2585 | V1-13_IGLJ5*01 | 837 | 1442 |
| 2059 | VH3-23_IGHD7-27*01>3_IGHJ5*01 | 2586 | V1-13_IGLJ5*01 | 837 | 1442 |
| 2060 | VH3-23_IGHD6-13*01>1'_IGHJ5*01 | 2635 | V1-13_IGLJ5*01 | 837 | 1442 |
| 2061 | VH3-23_IGHD6-13*01>2'_IGHJ5*01 | 2636 | V1-13_IGLJ5*01 | 837 | 1442 |
| 2062 | VH3-23_IGHD6-13*01>3'_IGHJ5*01 | 2637 | V1-13_IGLJ5*01 | 837 | 1442 |
| 2063 | VH3-23_IGHD6-19*01>1'_IGHJ5*01 | 2638 | V1-13_IGLJ5*01 | 837 | 1442 |
| 2064 | VH3-23_IGHD6-19*01>2'_IGHJ5*01 | 2639 | V1-13_IGLJ5*01 | 837 | 1442 |
| 2065 | VH3-23_IGHD6-19*01>2'_IGHJ5*01_B | 2640 | V1-13_IGLJ5*01 | 837 | 1442 |
| 2066 | VH3-23_IGHD6-25*01>1'_IGHJ5*01 | 2641 | V1-13_IGLJ5*01 | 837 | 1442 |
| 2067 | VH3-23_IGHD6-25*01>3'_IGHJ5*01 | 2642 | V1-13_IGLJ5*01 | 837 | 1442 |
| 2068 | VH3-23_IGHD7-27*01>1'_IGHJ5*01 | 2643 | V1-13_IGLJ5*01 | 837 | 1442 |
| 2069 | VH3-23_IGHD7-27*01>2'_IGHJ5*01 | 2644 | V1-13_IGLJ5*01 | 837 | 1442 |
| 2070 | VH3-23_IGHD6-6*01>2_IGHJ6*01 | 2693 | V1-13_IGLJ5*01 | 837 | 1442 |
| 2071 | VH3-23_IGHD6-6*01>2_IGHJ1*01 | 2118 | V1-16_IGLJ6*01 | 838 | 1443 |
| 2072 | VH3-23_IGHD6-13*01>1_IGHJ1*01 | 2119 | V1-16_IGLJ6*01 | 838 | 1443 |
| 2073 | VH3-23_IGHD6-13*01>2_IGHJ1*01 | 2120 | V1-16_IGLJ6*01 | 838 | 1443 |
| 2074 | VH3-23_IGHD6-19*01>1_IGHJ1*01 | 2121 | V1-16_IGLJ6*01 | 838 | 1443 |
| 2075 | VH3-23_IGHD6-19*01>2_IGHJ1*01 | 2122 | V1-16_IGLJ6*01 | 838 | 1443 |
| 2076 | VH3-23_IGHD6-25*01>1_IGHJ1*01 | 2123 | V1-16_IGLJ6*01 | 838 | 1443 |
| 2077 | VH3-23_IGHD6-25*01>2_IGHJ1*01 | 2124 | V1-16_IGLJ6*01 | 838 | 1443 |
| 2078 | VH3-23_IGHD7-27*01>1_IGHJ1*01 | 2125 | V1-16_IGLJ6*01 | 838 | 1443 |
| 2079 | VH3-23_IGHD7-27*01>3_IGHJ1*01 | 2126 | V1-16_IGLJ6*01 | 838 | 1443 |
| 2080 | VH3-23_IGHD6-13*01>1'_IGHJ1*01 | 2175 | V1-16_IGLJ6*01 | 838 | 1443 |
| 2081 | VH3-23_IGHD6-13*01>2'_IGHJ1*01 | 2176 | V1-16_IGLJ6*01 | 838 | 1443 |
| 2082 | VH3-23_IGHD6-13*01>2'_IGHJ1*01_B | 2177 | V1-16_IGLJ6*01 | 838 | 1443 |
| 2083 | VH3-23_IGHD6-19*01>1'_IGHJ1*01 | 2178 | V1-16_IGLJ6*01 | 838 | 1443 |
| 2084 | VH3-23_IGHD6-19*01>2'_IGHJ1*01 | 2179 | V1-16_IGLJ6*01 | 838 | 1443 |
| 2085 | VH3-23_IGHD6-19*01>2'_IGHJ1*01_B | 2180 | V1-16_IGLJ6*01 | 838 | 1443 |
| 2086 | VH3-23_IGHD6-25*01>1'_IGHJ1*01 | 2181 | V1-16_IGLJ6*01 | 838 | 1443 |
| 2087 | VH3-23_IGHD6-25*01>3'_IGHJ1*01 | 2182 | V1-16_IGLJ6*01 | 838 | 1443 |
| 2088 | VH3-23_IGHD7-27*01>1'_IGHJ1*01_B | 2183 | V1-16_IGLJ6*01 | 838 | 1443 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 2089 | VH3-23_IGHD7-27*01>2'_IGHJ1*01 | 2184 | V1-16_IGLJ6*01 | 838 | 1443 |
| 2090 | VH3-23_IGHD6-6*01>2_IGHJ2*01 | 2233 | V1-16_IGLJ6*01 | 838 | 1443 |
| 2091 | VH3-23_IGHD6-13*01>1_IGHJ2*01 | 2234 | V1-16_IGLJ6*01 | 838 | 1443 |
| 2092 | VH3-23_IGHD6-13*01>2_IGHJ2*01 | 2235 | V1-16_IGLJ6*01 | 838 | 1443 |
| 2093 | VH3-23_IGHD6-19*01>1_IGHJ2*01 | 2236 | V1-16_IGLJ6*01 | 838 | 1443 |
| 2094 | VH3-23_IGHD6-19*01>2_IGHJ2*01 | 2237 | V1-16_IGLJ6*01 | 838 | 1443 |
| 2095 | VH3-23_IGHD6-25*01>1_IGHJ2*01 | 2238 | V1-16_IGLJ6*01 | 838 | 1443 |
| 2096 | VH3-23_IGHD6-25*01>2_IGHJ2*01 | 2239 | V1-16_IGLJ6*01 | 838 | 1443 |
| 2097 | VH3-23_IGHD7-27*01>1_IGHJ2*01 | 2240 | V1-16_IGLJ6*01 | 838 | 1443 |
| 2098 | VH3-23_IGHD7-27*01>3_IGHJ2*01 | 2241 | V1-16_IGLJ6*01 | 838 | 1443 |
| 2099 | VH3-23_IGHD6-13*01>1'_IGHJ2*01 | 2290 | V1-16_IGLJ6*01 | 838 | 1443 |
| 2100 | VH3-23_IGHD6-13*01>2'_IGHJ2*01 | 2291 | V1-16_IGLJ6*01 | 838 | 1443 |
| 2101 | VH3-23_IGHD6-13*01>2'_IGHJ2*01_B | 2292 | V1-16_IGLJ6*01 | 838 | 1443 |
| 2102 | VH3-23_IGHD6-19*01>1'_IGHJ2*01 | 2293 | V1-16_IGLJ6*01 | 838 | 1443 |
| 2103 | VH3-23_IGHD6-19*01>2'_IGHJ2*01 | 2294 | V1-16_IGLJ6*01 | 838 | 1443 |
| 2104 | VH3-23_IGHD6-19*01>2'_IGHJ2*01_B | 2295 | V1-16_IGLJ6*01 | 838 | 1443 |
| 2105 | VH3-23_IGHD6-25*01>1'_IGHJ2*01 | 2296 | V1-16_IGLJ6*01 | 838 | 1443 |
| 2106 | VH3-23_IGHD6-25*01>3'_IGHJ2*01 | 2297 | V1-16_IGLJ6*01 | 838 | 1443 |
| 2107 | VH3-23_IGHD7-27*01>1'_IGHJ2*01 | 2298 | V1-16_IGLJ6*01 | 838 | 1443 |
| 2108 | VH3-23_IGHD7-27*01>2'_IGHJ2*01 | 2299 | V1-16_IGLJ6*01 | 838 | 1443 |
| 2109 | VH3-23_IGHD6-6*01>2_IGHJ3*01 | 2348 | V1-16_IGLJ6*01 | 838 | 1443 |
| 2110 | VH3-23_IGHD6-13*01>1_IGHJ3*01 | 2349 | V1-16_IGLJ6*01 | 838 | 1443 |
| 2111 | VH3-23_IGHD6-13*01>2_IGHJ3*01 | 2350 | V1-16_IGLJ6*01 | 838 | 1443 |
| 2112 | VH3-23_IGHD6-19*01>1_IGHJ3*01 | 2351 | V1-16_IGLJ6*01 | 838 | 1443 |
| 2113 | VH3-23_IGHD6-19*01>2_IGHJ3*01 | 2352 | V1-16_IGLJ6*01 | 838 | 1443 |
| 2114 | VH3-23_IGHD6-25*01>1_IGHJ3*01 | 2353 | V1-16_IGLJ6*01 | 838 | 1443 |
| 2115 | VH3-23_IGHD6-25*01>2_IGHJ3*01 | 2354 | V1-16_IGLJ6*01 | 838 | 1443 |
| 2116 | VH3-23_IGHD7-27*01>1_IGHJ3*01 | 2355 | V1-16_IGLJ6*01 | 838 | 1443 |
| 2117 | VH3-23_IGHD7-27*01>3_IGHJ3*01 | 2356 | V1-16_IGLJ6*01 | 838 | 1443 |
| 2118 | VH3-23_IGHD6-13*01>1'_IGHJ3*01 | 2405 | V1-16_IGLJ6*01 | 838 | 1443 |
| 2119 | VH3-23_IGHD6-13*01>2'_IGHJ3*01 | 2406 | V1-16_IGLJ6*01 | 838 | 1443 |
| 2120 | VH3-23_IGHD6-13*01>1_IGHJ6*01 | 2407 | V1-16_IGLJ6*01 | 838 | 1443 |
| 2121 | VH3-23_IGHD6-19*01>1'_IGHJ3*01 | 2408 | V1-16_IGLJ6*01 | 838 | 1443 |
| 2122 | VH3-23_IGHD6-19*01>2'_IGHJ3*01 | 2409 | V1-16_IGLJ6*01 | 838 | 1443 |
| 2123 | VH3-23_IGHD6-19*01>3'_IGHJ3*01 | 2410 | V1-16_IGLJ6*01 | 838 | 1443 |
| 2124 | VH3-23_IGHD6-25*01>1'_IGHJ3*01 | 2411 | V1-16_IGLJ6*01 | 838 | 1443 |
| 2125 | VH3-23_IGHD6-25*01>3'_IGHJ3*01 | 2412 | V1-16_IGLJ6*01 | 838 | 1443 |
| 2126 | VH3-23_IGHD7-27*01>1'_IGHJ3*01 | 2413 | V1-16_IGLJ6*01 | 838 | 1443 |
| 2127 | VH3-23_IGHD7-27*01>2'_IGHJ3*01 | 2414 | V1-16_IGLJ6*01 | 838 | 1443 |
| 2128 | VH3-23_IGHD6-6*01>2_IGHJ4*01 | 2463 | V1-16_IGLJ6*01 | 838 | 1443 |
| 2129 | VH3-23_IGHD6-13*01>1_IGHJ4*01 | 2464 | V1-16_IGLJ6*01 | 838 | 1443 |
| 2130 | VH3-23_IGHD6-13*01>2_IGHJ4*01 | 2465 | V1-16_IGLJ6*01 | 838 | 1443 |
| 2131 | VH3-23_IGHD6-19*01>1_IGHJ4*01 | 2466 | V1-16_IGLJ6*01 | 838 | 1443 |
| 2132 | VH3-23_IGHD6-19*01>2_IGHJ4*01 | 2467 | V1-16_IGLJ6*01 | 838 | 1443 |
| 2133 | VH3-23_IGHD6-25*01>1_IGHJ4*01 | 2468 | V1-16_IGLJ6*01 | 838 | 1443 |
| 2134 | VH3-23_IGHD6-25*01>2_IGHJ4*01 | 2469 | V1-16_IGLJ6*01 | 838 | 1443 |
| 2135 | VH3-23_IGHD7-27*01>1_IGHJ4*01 | 2470 | V1-16_IGLJ6*01 | 838 | 1443 |
| 2136 | VH3-23_IGHD7-27*01>3_IGHJ4*01 | 2471 | V1-16_IGLJ6*01 | 838 | 1443 |
| 2137 | VH3-23_IGHD6-13*01>1'_IGHJ4*01 | 2520 | V1-16_IGLJ6*01 | 838 | 1443 |
| 2138 | VH3-23_IGHD6-13*01>2'_IGHJ4*01 | 2521 | V1-16_IGLJ6*01 | 838 | 1443 |
| 2139 | VH3-23_IGHD6-13*01>2'_IGHJ4*01_B | 2522 | V1-16_IGLJ6*01 | 838 | 1443 |
| 2140 | VH3-23_IGHD6-19*01>1'_IGHJ4*01 | 2523 | V1-16_IGLJ6*01 | 838 | 1443 |
| 2141 | VH3-23_IGHD6-19*01>2'_IGHJ4*01 | 2524 | V1-16_IGLJ6*01 | 838 | 1443 |
| 2142 | VH3-23_IGHD6-19*01>2'_IGHJ4*01_B | 2525 | V1-16_IGLJ6*01 | 838 | 1443 |
| 2143 | VH3-23_IGHD6-25*01>1'_IGHJ4*01 | 2526 | V1-16_IGLJ6*01 | 838 | 1443 |
| 2144 | VH3-23_IGHD6-25*01>3'_IGHJ4*01 | 2527 | V1-16_IGLJ6*01 | 838 | 1443 |
| 2145 | VH3-23_IGHD7-27*01>1'_IGHJ4*01 | 2528 | V1-16_IGLJ6*01 | 838 | 1443 |
| 2146 | VH3-23_IGHD7-27*01>2'_IGHJ4*01 | 2529 | V1-16_IGLJ6*01 | 838 | 1443 |
| 2147 | VH3-23_IGHD6-6*01>2_IGHJ5*01 | 2578 | V1-16_IGLJ6*01 | 838 | 1443 |
| 2148 | VH3-23_IGHD6-13*01>1_IGHJ5*01 | 2579 | V1-16_IGLJ6*01 | 838 | 1443 |
| 2149 | VH3-23_IGHD6-13*01>2_IGHJ5*01 | 2580 | V1-16_IGLJ6*01 | 838 | 1443 |
| 2150 | VH3-23_IGHD6-19*01>1_IGHJ5*01 | 2581 | V1-16_IGLJ6*01 | 838 | 1443 |
| 2151 | VH3-23_IGHD6-19*01>2_IGHJ5*01 | 2582 | V1-16_IGLJ6*01 | 838 | 1443 |
| 2152 | VH3-23_IGHD6-25*01>1_IGHJ5*01 | 2583 | V1-16_IGLJ6*01 | 838 | 1443 |
| 2153 | VH3-23_IGHD6-25*01>2_IGHJ5*01 | 2584 | V1-16_IGLJ6*01 | 838 | 1443 |
| 2154 | VH3-23_IGHD7-27*01>1_IGHJ5*01 | 2585 | V1-16_IGLJ6*01 | 838 | 1443 |
| 2155 | VH3-23_IGHD7-27*01>3_IGHJ5*01 | 2586 | V1-16_IGLJ6*01 | 838 | 1443 |
| 2156 | VH3-23_IGHD6-13*01>1'_IGHJ5*01 | 2635 | V1-16_IGLJ6*01 | 838 | 1443 |
| 2157 | VH3-23_IGHD6-13*01>2'_IGHJ5*01 | 2636 | V1-16_IGLJ6*01 | 838 | 1443 |
| 2158 | VH3-23_IGHD6-13*01>3'_IGHJ5*01 | 2637 | V1-16_IGLJ6*01 | 838 | 1443 |
| 2159 | VH3-23_IGHD6-19*01>1'_IGHJ5*01 | 2638 | V1-16_IGLJ6*01 | 838 | 1443 |
| 2160 | VH3-23_IGHD6-19*01>2'_IGHJ5*01 | 2639 | V1-16_IGLJ6*01 | 838 | 1443 |
| 2161 | VH3-23_IGHD6-19*01>2'_IGHJ5*01_B | 2640 | V1-16_IGLJ6*01 | 838 | 1443 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 2162 | VH3-23_IGHD6-25*01>1'_IGHJ5*01 | 2641 | V1-16_IGLJ6*01 | 838 | 1443 |
| 2163 | VH3-23_IGHD6-25*01>3'_IGHJ5*01 | 2642 | V1-16_IGLJ6*01 | 838 | 1443 |
| 2164 | VH3-23_IGHD7-27*01>1'_IGHJ5*01 | 2643 | V1-16_IGLJ6*01 | 838 | 1443 |
| 2165 | VH3-23_IGHD7-27*01>2'_IGHJ5*01 | 2644 | V1-16_IGLJ6*01 | 838 | 1443 |
| 2166 | VH3-23_IGHD6-6*01>2_IGHJ6*01 | 2693 | V1-16_IGLJ6*01 | 838 | 1443 |
| 2167 | VH3-23_IGHD6-6*01>2_IGHJ1*01 | 2118 | V1-2_IGLJ7*01 | 840 | 1445 |
| 2168 | VH3-23_IGHD6-13*01>1_IGHJ1*01 | 2119 | V1-2_IGLJ7*01 | 840 | 1445 |
| 2169 | VH3-23_IGHD6-13*01>2_IGHJ1*01 | 2120 | V1-2_IGLJ7*01 | 840 | 1445 |
| 2170 | VH3-23_IGHD6-19*01>1_IGHJ1*01 | 2121 | V1-2_IGLJ7*01 | 840 | 1445 |
| 2171 | VH3-23_IGHD6-19*01>2_IGHJ1*01 | 2122 | V1-2_IGLJ7*01 | 840 | 1445 |
| 2172 | VH3-23_IGHD6-25*01>1_IGHJ1*01 | 2123 | V1-2_IGLJ7*01 | 840 | 1445 |
| 2173 | VH3-23_IGHD6-25*01>2_IGHJ1*01 | 2124 | V1-2_IGLJ7*01 | 840 | 1445 |
| 2174 | VH3-23_IGHD7-27*01>1_IGHJ1*01 | 2125 | V1-2_IGLJ7*01 | 840 | 1445 |
| 2175 | VH3-23_IGHD7-27*01>3_IGHJ1*01 | 2126 | V1-2_IGLJ7*01 | 840 | 1445 |
| 2176 | VH3-23_IGHD6-13*01>1'_IGHJ1*01 | 2175 | V1-2_IGLJ7*01 | 840 | 1445 |
| 2177 | VH3-23_IGHD6-13*01>2'_IGHJ1*01 | 2176 | V1-2_IGLJ7*01 | 840 | 1445 |
| 2178 | VH3-23_IGHD6-13*01>2'_IGHJ1*01_B | 2177 | V1-2_IGLJ7*01 | 840 | 1445 |
| 2179 | VH3-23_IGHD6-19*01>1'_IGHJ1*01 | 2178 | V1-2_IGLJ7*01 | 840 | 1445 |
| 2180 | VH3-23_IGHD6-19*01>2'_IGHJ1*01 | 2179 | V1-2_IGLJ7*01 | 840 | 1445 |
| 2181 | VH3-23_IGHD6-19*01>2'_IGHJ1*01_B | 2180 | V1-2_IGLJ7*01 | 840 | 1445 |
| 2182 | VH3-23_IGHD6-25*01>1'_IGHJ1*01 | 2181 | V1-2_IGLJ7*01 | 840 | 1445 |
| 2183 | VH3-23_IGHD6-25*01>3'_IGHJ1*01 | 2182 | V1-2_IGLJ7*01 | 840 | 1445 |
| 2184 | VH3-23_IGHD7-27*01>1'_IGHJ1*01_B | 2183 | V1-2_IGLJ7*01 | 840 | 1445 |
| 2185 | VH3-23_IGHD7-27*01>2'_IGHJ1*01 | 2184 | V1-2_IGLJ7*01 | 840 | 1445 |
| 2186 | VH3-23_IGHD6-6*01>2_IGHJ2*01 | 2233 | V1-2_IGLJ7*01 | 840 | 1445 |
| 2187 | VH3-23_IGHD6-13*01>1_IGHJ2*01 | 2234 | V1-2_IGLJ7*01 | 840 | 1445 |
| 2188 | VH3-23_IGHD6-13*01>2_IGHJ2*01 | 2235 | V1-2_IGLJ7*01 | 840 | 1445 |
| 2189 | VH3-23_IGHD6-19*01>1_IGHJ2*01 | 2236 | V1-2_IGLJ7*01 | 840 | 1445 |
| 2190 | VH3-23_IGHD6-19*01>2_IGHJ2*01 | 2237 | V1-2_IGLJ7*01 | 840 | 1445 |
| 2191 | VH3-23_IGHD6-25*01>1_IGHJ2*01 | 2238 | V1-2_IGLJ7*01 | 840 | 1445 |
| 2192 | VH3-23_IGHD6-25*01>2_IGHJ2*01 | 2239 | V1-2_IGLJ7*01 | 840 | 1445 |
| 2193 | VH3-23_IGHD7-27*01>1_IGHJ2*01 | 2240 | V1-2_IGLJ7*01 | 840 | 1445 |
| 2194 | VH3-23_IGHD7-27*01>3_IGHJ2*01 | 2241 | V1-2_IGLJ7*01 | 840 | 1445 |
| 2195 | VH3-23_IGHD6-13*01>1'_IGHJ2*01 | 2290 | V1-2_IGLJ7*01 | 840 | 1445 |
| 2196 | VH3-23_IGHD6-13*01>2'_IGHJ2*01 | 2291 | V1-2_IGLJ7*01 | 840 | 1445 |
| 2197 | VH3-23_IGHD6-13*01>2'_IGHJ2*01_B | 2292 | V1-2_IGLJ7*01 | 840 | 1445 |
| 2198 | VH3-23_IGHD6-19*01>1'_IGHJ2*01 | 2293 | V1-2_IGLJ7*01 | 840 | 1445 |
| 2199 | VH3-23_IGHD6-19*01>2'_IGHJ2*01 | 2294 | V1-2_IGLJ7*01 | 840 | 1445 |
| 2200 | VH3-23_IGHD6-19*01>2'_IGHJ2*01_B | 2295 | V1-2_IGLJ7*01 | 840 | 1445 |
| 2201 | VH3-23_IGHD6-25*01>1'_IGHJ2*01 | 2296 | V1-2_IGLJ7*01 | 840 | 1445 |
| 2202 | VH3-23_IGHD6-25*01>3'_IGHJ2*01 | 2297 | V1-2_IGLJ7*01 | 840 | 1445 |
| 2203 | VH3-23_IGHD7-27*01>1'_IGHJ2*01 | 2298 | V1-2_IGLJ7*01 | 840 | 1445 |
| 2204 | VH3-23_IGHD7-27*01>2'_IGHJ2*01 | 2299 | V1-2_IGLJ7*01 | 840 | 1445 |
| 2205 | VH3-23_IGHD6-6*01>2_IGHJ3*01 | 2348 | V1-2_IGLJ7*01 | 840 | 1445 |
| 2206 | VH3-23_IGHD6-13*01>1_IGHJ3*01 | 2349 | V1-2_IGLJ7*01 | 840 | 1445 |
| 2207 | VH3-23_IGHD6-13*01>2_IGHJ3*01 | 2350 | V1-2_IGLJ7*01 | 840 | 1445 |
| 2208 | VH3-23_IGHD6-19*01>1_IGHJ3*01 | 2351 | V1-2_IGLJ7*01 | 840 | 1445 |
| 2209 | VH3-23_IGHD6-19*01>2_IGHJ3*01 | 2352 | V1-2_IGLJ7*01 | 840 | 1445 |
| 2210 | VH3-23_IGHD6-25*01>1_IGHJ3*01 | 2353 | V1-2_IGLJ7*01 | 840 | 1445 |
| 2211 | VH3-23_IGHD6-25*01>2_IGHJ3*01 | 2354 | V1-2_IGLJ7*01 | 840 | 1445 |
| 2212 | VH3-23_IGHD7-27*01>1_IGHJ3*01 | 2355 | V1-2_IGLJ7*01 | 840 | 1445 |
| 2213 | VH3-23_IGHD7-27*01>3_IGHJ3*01 | 2356 | V1-2_IGLJ7*01 | 840 | 1445 |
| 2214 | VH3-23_IGHD6-13*01>1'_IGHJ3*01 | 2405 | V1-2_IGLJ7*01 | 840 | 1445 |
| 2215 | VH3-23_IGHD6-13*01>2'_IGHJ3*01 | 2406 | V1-2_IGLJ7*01 | 840 | 1445 |
| 2216 | VH3-23_IGHD6-13*01>1'_IGHJ6*01 | 2407 | V1-2_IGLJ7*01 | 840 | 1445 |
| 2217 | VH3-23_IGHD6-19*01>1'_IGHJ3*01 | 2408 | V1-2_IGLJ7*01 | 840 | 1445 |
| 2218 | VH3-23_IGHD6-19*01>2'_IGHJ3*01 | 2409 | V1-2_IGLJ7*01 | 840 | 1445 |
| 2219 | VH3-23_IGHD6-19*01>3'_IGHJ3*01 | 2410 | V1-2_IGLJ7*01 | 840 | 1445 |
| 2220 | VH3-23_IGHD6-25*01>1'_IGHJ3*01 | 2411 | V1-2_IGLJ7*01 | 840 | 1445 |
| 2221 | VH3-23_IGHD6-25*01>3'_IGHJ3*01 | 2412 | V1-2_IGLJ7*01 | 840 | 1445 |
| 2222 | VH3-23_IGHD7-27*01>1'_IGHJ3*01 | 2413 | V1-2_IGLJ7*01 | 840 | 1445 |
| 2223 | VH3-23_IGHD7-27*01>2'_IGHJ3*01 | 2414 | V1-2_IGLJ7*01 | 840 | 1445 |
| 2224 | VH3-23_IGHD6-6*01>2_IGHJ4*01 | 2463 | V1-2_IGLJ7*01 | 840 | 1445 |
| 2225 | VH3-23_IGHD6-13*01>1_IGHJ4*01 | 2464 | V1-2_IGLJ7*01 | 840 | 1445 |
| 2226 | VH3-23_IGHD6-13*01>2_IGHJ4*01 | 2465 | V1-2_IGLJ7*01 | 840 | 1445 |
| 2227 | VH3-23_IGHD6-19*01>1_IGHJ4*01 | 2466 | V1-2_IGLJ7*01 | 840 | 1445 |
| 2228 | VH3-23_IGHD6-19*01>2_IGHJ4*01 | 2467 | V1-2_IGLJ7*01 | 840 | 1445 |
| 2229 | VH3-23_IGHD6-25*01>1_IGHJ4*01 | 2468 | V1-2_IGLJ7*01 | 840 | 1445 |
| 2230 | VH3-23_IGHD6-25*01>2_IGHJ4*01 | 2469 | V1-2_IGLJ7*01 | 840 | 1445 |
| 2231 | VH3-23_IGHD7-27*01>1_IGHJ4*01 | 2470 | V1-2_IGLJ7*01 | 840 | 1445 |
| 2232 | VH3-23_IGHD7-27*01>3_IGHJ4*01 | 2471 | V1-2_IGLJ7*01 | 840 | 1445 |
| 2233 | VH3-23_IGHD6-13*01>1'_IGHJ4*01 | 2520 | V1-2_IGLJ7*01 | 840 | 1445 |
| 2234 | VH3-23_IGHD6-13*01>2'_IGHJ4*01 | 2521 | V1-2_IGLJ7*01 | 840 | 1445 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 2235 | VH3-23_IGHD6-13*01>2_IGHJ4*01_B | 2522 | V1-2_IGLJ7*01 | 840 | 1445 |
| 2236 | VH3-23_IGHD6-19*01>1'_IGHJ4*01 | 2523 | V1-2_IGLJ7*01 | 840 | 1445 |
| 2237 | VH3-23_IGHD6-19*01>2'_IGHJ4*01 | 2524 | V1-2_IGLJ7*01 | 840 | 1445 |
| 2238 | VH3-23_IGHD6-19*01>2_IGHJ4*01_B | 2525 | V1-2_IGLJ7*01 | 840 | 1445 |
| 2239 | VH3-23_IGHD6-25*01>1'_IGHJ4*01 | 2526 | V1-2_IGLJ7*01 | 840 | 1445 |
| 2240 | VH3-23_IGHD6-25*01>3'_IGHJ4*01 | 2527 | V1-2_IGLJ7*01 | 840 | 1445 |
| 2241 | VH3-23_IGHD7-27*01>1'_IGHJ4*01 | 2528 | V1-2_IGLJ7*01 | 840 | 1445 |
| 2242 | VH3-23_IGHD7-27*01>2'_IGHJ4*01 | 2529 | V1-2_IGLJ7*01 | 840 | 1445 |
| 2243 | VH3-23_IGHD6-6*01>2_IGHJ5*01 | 2578 | V1-2_IGLJ7*01 | 840 | 1445 |
| 2244 | VH3-23_IGHD6-13*01>1_IGHJ5*01 | 2579 | V1-2_IGLJ7*01 | 840 | 1445 |
| 2245 | VH3-23_IGHD6-13*01>2_IGHJ5*01 | 2580 | V1-2_IGLJ7*01 | 840 | 1445 |
| 2246 | VH3-23_IGHD6-19*01>1_IGHJ5*01 | 2581 | V1-2_IGLJ7*01 | 840 | 1445 |
| 2247 | VH3-23_IGHD6-19*01>2_IGHJ5*01 | 2582 | V1-2_IGLJ7*01 | 840 | 1445 |
| 2248 | VH3-23_IGHD6-25*01>1_IGHJ5*01 | 2583 | V1-2_IGLJ7*01 | 840 | 1445 |
| 2249 | VH3-23_IGHD6-25*01>2_IGHJ5*01 | 2584 | V1-2_IGLJ7*01 | 840 | 1445 |
| 2250 | VH3-23_IGHD7-27*01>1_IGHJ5*01 | 2585 | V1-2_IGLJ7*01 | 840 | 1445 |
| 2251 | VH3-23_IGHD7-27*01>3_IGHJ5*01 | 2586 | V1-2_IGLJ7*01 | 840 | 1445 |
| 2252 | VH3-23_IGHD6-13*01>1'_IGHJ5*01 | 2635 | V1-2_IGLJ7*01 | 840 | 1445 |
| 2253 | VH3-23_IGHD6-13*01>2'_IGHJ5*01 | 2636 | V1-2_IGLJ7*01 | 840 | 1445 |
| 2254 | VH3-23_IGHD6-13*01>3'_IGHJ5*01 | 2637 | V1-2_IGLJ7*01 | 840 | 1445 |
| 2255 | VH3-23_IGHD6-19*01>1'_IGHJ5*01 | 2638 | V1-2_IGLJ7*01 | 840 | 1445 |
| 2256 | VH3-23_IGHD6-19*01>2'_IGHJ5*01 | 2639 | V1-2_IGLJ7*01 | 840 | 1445 |
| 2257 | VH3-23_IGHD6-19*01>2_IGHJ5*01_B | 2640 | V1-2_IGLJ7*01 | 840 | 1445 |
| 2258 | VH3-23_IGHD6-25*01>1'_IGHJ5*01 | 2641 | V1-2_IGLJ7*01 | 840 | 1445 |
| 2259 | VH3-23_IGHD6-25*01>3'_IGHJ5*01 | 2642 | V1-2_IGLJ7*01 | 840 | 1445 |
| 2260 | VH3-23_IGHD7-27*01>1'_IGHJ5*01 | 2643 | V1-2_IGLJ7*01 | 840 | 1445 |
| 2261 | VH3-23_IGHD7-27*01>2'_IGHJ5*01 | 2644 | V1-2_IGLJ7*01 | 840 | 1445 |
| 2262 | VH3-23_IGHD6-6*01>2_IGHJ6*01 | 2693 | V1-2_IGLJ7*01 | 840 | 1445 |
| 2263 | VH3-23_IGHD6-6*01>2_IGHJ1*01 | 2118 | V1-20_IGLJ6*01 | 841 | 1446 |
| 2264 | VH3-23_IGHD6-13*01>1_IGHJ1*01 | 2119 | V1-20_IGLJ6*01 | 841 | 1446 |
| 2265 | VH3-23_IGHD6-13*01>2_IGHJ1*01 | 2120 | V1-20_IGLJ6*01 | 841 | 1446 |
| 2266 | VH3-23_IGHD6-19*01>1_IGHJ1*01 | 2121 | V1-20_IGLJ6*01 | 841 | 1446 |
| 2267 | VH3-23_IGHD6-19*01>2_IGHJ1*01 | 2122 | V1-20_IGLJ6*01 | 841 | 1446 |
| 2268 | VH3-23_IGHD6-25*01>1_IGHJ1*01 | 2123 | V1-20_IGLJ6*01 | 841 | 1446 |
| 2269 | VH3-23_IGHD6-25*01>2_IGHJ1*01 | 2124 | V1-20_IGLJ6*01 | 841 | 1446 |
| 2270 | VH3-23_IGHD7-27*01>1_IGHJ1*01 | 2125 | V1-20_IGLJ6*01 | 841 | 1446 |
| 2271 | VH3-23_IGHD7-27*01>3_IGHJ1*01 | 2126 | V1-20_IGLJ6*01 | 841 | 1446 |
| 2272 | VH3-23_IGHD6-13*01>1'_IGHJ1*01 | 2175 | V1-20_IGLJ6*01 | 841 | 1446 |
| 2273 | VH3-23_IGHD6-13*01>2'_IGHJ1*01 | 2176 | V1-20_IGLJ6*01 | 841 | 1446 |
| 2274 | VH3-23_IGHD6-13*01>2_IGHJ1*01_B | 2177 | V1-20_IGLJ6*01 | 841 | 1446 |
| 2275 | VH3-23_IGHD6-19*01>1'_IGHJ1*01 | 2178 | V1-20_IGLJ6*01 | 841 | 1446 |
| 2276 | VH3-23_IGHD6-19*01>2'_IGHJ1*01 | 2179 | V1-20_IGLJ6*01 | 841 | 1446 |
| 2277 | VH3-23_IGHD6-19*01>2_IGHJ1*01_B | 2180 | V1-20_IGLJ6*01 | 841 | 1446 |
| 2278 | VH3-23_IGHD6-25*01>1'_IGHJ1*01 | 2181 | V1-20_IGLJ6*01 | 841 | 1446 |
| 2279 | VH3-23_IGHD6-25*01>3'_IGHJ1*01 | 2182 | V1-20_IGLJ6*01 | 841 | 1446 |
| 2280 | VH3-23_IGHD7-27*01>1'_IGHJ1*01_B | 2183 | V1-20_IGLJ6*01 | 841 | 1446 |
| 2281 | VH3-23_IGHD7-27*01>2'_IGHJ1*01 | 2184 | V1-20_IGLJ6*01 | 841 | 1446 |
| 2282 | VH3-23_IGHD6-6*01>2_IGHJ2*01 | 2233 | V1-20_IGLJ6*01 | 841 | 1446 |
| 2283 | VH3-23_IGHD6-13*01>1_IGHJ2*01 | 2234 | V1-20_IGLJ6*01 | 841 | 1446 |
| 2284 | VH3-23_IGHD6-13*01>2_IGHJ2*01 | 2235 | V1-20_IGLJ6*01 | 841 | 1446 |
| 2285 | VH3-23_IGHD6-19*01>1_IGHJ2*01 | 2236 | V1-20_IGLJ6*01 | 841 | 1446 |
| 2286 | VH3-23_IGHD6-19*01>2_IGHJ2*01 | 2237 | V1-20_IGLJ6*01 | 841 | 1446 |
| 2287 | VH3-23_IGHD6-25*01>1_IGHJ2*01 | 2238 | V1-20_IGLJ6*01 | 841 | 1446 |
| 2288 | VH3-23_IGHD6-25*01>2_IGHJ2*01 | 2239 | V1-20_IGLJ6*01 | 841 | 1446 |
| 2289 | VH3-23_IGHD7-27*01>1_IGHJ2*01 | 2240 | V1-20_IGLJ6*01 | 841 | 1446 |
| 2290 | VH3-23_IGHD7-27*01>3_IGHJ2*01 | 2241 | V1-20_IGLJ6*01 | 841 | 1446 |
| 2291 | VH3-23_IGHD6-13*01>1'_IGHJ2*01 | 2290 | V1-20_IGLJ6*01 | 841 | 1446 |
| 2292 | VH3-23_IGHD6-13*01>2'_IGHJ2*01 | 2291 | V1-20_IGLJ6*01 | 841 | 1446 |
| 2293 | VH3-23_IGHD6-13*01>2_IGHJ2*01_B | 2292 | V1-20_IGLJ6*01 | 841 | 1446 |
| 2294 | VH3-23_IGHD6-19*01>1'_IGHJ2*01 | 2293 | V1-20_IGLJ6*01 | 841 | 1446 |
| 2295 | VH3-23_IGHD6-19*01>2'_IGHJ2*01 | 2294 | V1-20_IGLJ6*01 | 841 | 1446 |
| 2296 | VH3-23_IGHD6-19*01>2_IGHJ2*01_B | 2295 | V1-20_IGLJ6*01 | 841 | 1446 |
| 2297 | VH3-23_IGHD6-25*01>1'_IGHJ2*01 | 2296 | V1-20_IGLJ6*01 | 841 | 1446 |
| 2298 | VH3-23_IGHD6-25*01>3'_IGHJ2*01 | 2297 | V1-20_IGLJ6*01 | 841 | 1446 |
| 2299 | VH3-23_IGHD7-27*01>1'_IGHJ2*01 | 2298 | V1-20_IGLJ6*01 | 841 | 1446 |
| 2300 | VH3-23_IGHD7-27*01>2'_IGHJ2*01 | 2299 | V1-20_IGLJ6*01 | 841 | 1446 |
| 2301 | VH3-23_IGHD6-6*01>2_IGHJ3*01 | 2348 | V1-20_IGLJ6*01 | 841 | 1446 |
| 2302 | VH3-23_IGHD6-13*01>1_IGHJ3*01 | 2349 | V1-20_IGLJ6*01 | 841 | 1446 |
| 2303 | VH3-23_IGHD6-13*01>2_IGHJ3*01 | 2350 | V1-20_IGLJ6*01 | 841 | 1446 |
| 2304 | VH3-23_IGHD6-19*01>1_IGHJ3*01 | 2351 | V1-20_IGLJ6*01 | 841 | 1446 |
| 2305 | VH3-23_IGHD6-19*01>2_IGHJ3*01 | 2352 | V1-20_IGLJ6*01 | 841 | 1446 |
| 2306 | VH3-23_IGHD6-25*01>1_IGHJ3*01 | 2353 | V1-20_IGLJ6*01 | 841 | 1446 |
| 2307 | VH3-23_IGHD6-25*01>2_IGHJ3*01 | 2354 | V1-20_IGLJ6*01 | 841 | 1446 |

TABLE 17A-continued

Exemplary Nucleic Acid Paired Library

| HEAVY CHAIN Name | RS SEQ ID NO | LIGHT CHAIN Name | RS SEQ ID NO | NO RS SEQ ID NO |
|---|---|---|---|---|
| 2308 VH3-23__IGHD7-27*01>1__IGHJ3*01 | 2355 | V1-20__IGLJ6*01 | 841 | 1446 |
| 2309 VH3-23__IGHD7-27*01>3__IGHJ3*01 | 2356 | V1-20__IGLJ6*01 | 841 | 1446 |
| 2310 VH3-23__IGHD6-13*01>1'__IGHJ3*01 | 2405 | V1-20__IGLJ6*01 | 841 | 1446 |
| 2311 VH3-23__IGHD6-13*01>2'__IGHJ3*01 | 2406 | V1-20__IGLJ6*01 | 841 | 1446 |
| 2312 VH3-23__IGHD6-13*01>1__IGHJ6*01 | 2407 | V1-20__IGLJ6*01 | 841 | 1446 |
| 2313 VH3-23__IGHD6-19*01>1'__IGHJ3*01 | 2408 | V1-20__IGLJ6*01 | 841 | 1446 |
| 2314 VH3-23__IGHD6-19*01>2'__IGHJ3*01 | 2409 | V1-20__IGLJ6*01 | 841 | 1446 |
| 2315 VH3-23__IGHD6-19*01>3'__IGHJ3*01 | 2410 | V1-20__IGLJ6*01 | 841 | 1446 |
| 2316 VH3-23__IGHD6-25*01>1'__IGHJ3*01 | 2411 | V1-20__IGLJ6*01 | 841 | 1446 |
| 2317 VH3-23__IGHD6-25*01>3'__IGHJ3*01 | 2412 | V1-20__IGLJ6*01 | 841 | 1446 |
| 2318 VH3-23__IGHD7-27*01>1'__IGHJ3*01 | 2413 | V1-20__IGLJ6*01 | 841 | 1446 |
| 2319 VH3-23__IGHD7-27*01>2'__IGHJ3*01 | 2414 | V1-20__IGLJ6*01 | 841 | 1446 |
| 2320 VH3-23__IGHD6-6*01>2__IGHJ4*01 | 2463 | V1-20__IGLJ6*01 | 841 | 1446 |
| 2321 VH3-23__IGHD6-13*01>1__IGHJ4*01 | 2464 | V1-20__IGLJ6*01 | 841 | 1446 |
| 2322 VH3-23__IGHD6-13*01>2__IGHJ4*01 | 2465 | V1-20__IGLJ6*01 | 841 | 1446 |
| 2323 VH3-23__IGHD6-19*01>1__IGHJ4*01 | 2466 | V1-20__IGLJ6*01 | 841 | 1446 |
| 2324 VH3-23__IGHD6-19*01>2__IGHJ4*01 | 2467 | V1-20__IGLJ6*01 | 841 | 1446 |
| 2325 VH3-23__IGHD6-25*01>1__IGHJ4*01 | 2468 | V1-20__IGLJ6*01 | 841 | 1446 |
| 2326 VH3-23__IGHD6-25*01>2__IGHJ4*01 | 2469 | V1-20__IGLJ6*01 | 841 | 1446 |
| 2327 VH3-23__IGHD7-27*01>1__IGHJ4*01 | 2470 | V1-20__IGLJ6*01 | 841 | 1446 |
| 2328 VH3-23__IGHD7-27*01>3__IGHJ4*01 | 2471 | V1-20__IGLJ6*01 | 841 | 1446 |
| 2329 VH3-23__IGHD6-13*01>1'__IGHJ4*01 | 2520 | V1-20__IGLJ6*01 | 841 | 1446 |
| 2330 VH3-23__IGHD6-13*01>2'__IGHJ4*01 | 2521 | V1-20__IGLJ6*01 | 841 | 1446 |
| 2331 VH3-23__IGHD6-13*01>2'__IGHJ4*01_B | 2522 | V1-20__IGLJ6*01 | 841 | 1446 |
| 2332 VH3-23__IGHD6-19*01>1'__IGHJ4*01 | 2523 | V1-20__IGLJ6*01 | 841 | 1446 |
| 2333 VH3-23__IGHD6-19*01>2'__IGHJ4*01 | 2524 | V1-20__IGLJ6*01 | 841 | 1446 |
| 2334 VH3-23__IGHD6-19*01>2'__IGHJ4*01_B | 2525 | V1-20__IGLJ6*01 | 841 | 1446 |
| 2335 VH3-23__IGHD6-25*01>1'__IGHJ4*01 | 2526 | V1-20__IGLJ6*01 | 841 | 1446 |
| 2336 VH3-23__IGHD6-25*01>3'__IGHJ4*01 | 2527 | V1-20__IGLJ6*01 | 841 | 1446 |
| 2337 VH3-23__IGHD7-27*01>1'__IGHJ4*01 | 2528 | V1-20__IGLJ6*01 | 841 | 1446 |
| 2338 VH3-23__IGHD7-27*01>2'__IGHJ4*01 | 2529 | V1-20__IGLJ6*01 | 841 | 1446 |
| 2339 VH3-23__IGHD6-6*01>2__IGHJ5*01 | 2578 | V1-20__IGLJ6*01 | 841 | 1446 |
| 2340 VH3-23__IGHD6-13*01>1__IGHJ5*01 | 2579 | V1-20__IGLJ6*01 | 841 | 1446 |
| 2341 VH3-23__IGHD6-13*01>2__IGHJ5*01 | 2580 | V1-20__IGLJ6*01 | 841 | 1446 |
| 2342 VH3-23__IGHD6-19*01>1__IGHJ5*01 | 2581 | V1-20__IGLJ6*01 | 841 | 1446 |
| 2343 VH3-23__IGHD6-19*01>2__IGHJ5*01 | 2582 | V1-20__IGLJ6*01 | 841 | 1446 |
| 2344 VH3-23__IGHD6-25*01>1__IGHJ5*01 | 2583 | V1-20__IGLJ6*01 | 841 | 1446 |
| 2345 VH3-23__IGHD6-25*01>2__IGHJ5*01 | 2584 | V1-20__IGLJ6*01 | 841 | 1446 |
| 2346 VH3-23__IGHD7-27*01>1__IGHJ5*01 | 2585 | V1-20__IGLJ6*01 | 841 | 1446 |
| 2347 VH3-23__IGHD7-27*01>3__IGHJ5*01 | 2586 | V1-20__IGLJ6*01 | 841 | 1446 |
| 2348 VH3-23__IGHD6-13*01>1'__IGHJ5*01 | 2635 | V1-20__IGLJ6*01 | 841 | 1446 |
| 2349 VH3-23__IGHD6-13*01>2'__IGHJ5*01 | 2636 | V1-20__IGLJ6*01 | 841 | 1446 |
| 2350 VH3-23__IGHD6-13*01>3'__IGHJ5*01 | 2637 | V1-20__IGLJ6*01 | 841 | 1446 |
| 2351 VH3-23__IGHD6-19*01>1'__IGHJ5*01 | 2638 | V1-20__IGLJ6*01 | 841 | 1446 |
| 2352 VH3-23__IGHD6-19*01>2'__IGHJ5*01 | 2639 | V1-20__IGLJ6*01 | 841 | 1446 |
| 2353 VH3-23__IGHD6-19*01>2'__IGHJ5*01_B | 2640 | V1-20__IGLJ6*01 | 841 | 1446 |
| 2354 VH3-23__IGHD6-25*01>1'__IGHJ5*01 | 2641 | V1-20__IGLJ6*01 | 841 | 1446 |
| 2355 VH3-23__IGHD6-25*01>3'__IGHJ5*01 | 2642 | V1-20__IGLJ6*01 | 841 | 1446 |
| 2356 VH3-23__IGHD7-27*01>1'__IGHJ5*01 | 2643 | V1-20__IGLJ6*01 | 841 | 1446 |
| 2357 VH3-23__IGHD7-27*01>2'__IGHJ5*01 | 2644 | V1-20__IGLJ6*01 | 841 | 1446 |
| 2358 VH3-23__IGHD6-6*01>2__IGHJ6*01 | 2693 | V1-20__IGLJ6*01 | 841 | 1446 |
| 2359 VH3-23__IGHD6-6*01>2__IGHJ1*01 | 2118 | V1-3__IGLJ1*01 | 842 | 1447 |
| 2360 VH3-23__IGHD6-13*01>1__IGHJ1*01 | 2119 | V1-3__IGLJ1*01 | 842 | 1447 |
| 2361 VH3-23__IGHD6-13*01>2__IGHJ1*01 | 2120 | V1-3__IGLJ1*01 | 842 | 1447 |
| 2362 VH3-23__IGHD6-19*01>1__IGHJ1*01 | 2121 | V1-3__IGLJ1*01 | 842 | 1447 |
| 2363 VH3-23__IGHD6-19*01>2__IGHJ1*01 | 2122 | V1-3__IGLJ1*01 | 842 | 1447 |
| 2364 VH3-23__IGHD6-25*01>1__IGHJ1*01 | 2123 | V1-3__IGLJ1*01 | 842 | 1447 |
| 2365 VH3-23__IGHD6-25*01>2__IGHJ1*01 | 2124 | V1-3__IGLJ1*01 | 842 | 1447 |
| 2366 VH3-23__IGHD7-27*01>1__IGHJ1*01 | 2125 | V1-3__IGLJ1*01 | 842 | 1447 |
| 2367 VH3-23__IGHD7-27*01>3__IGHJ1*01 | 2126 | V1-3__IGLJ1*01 | 842 | 1447 |
| 2368 VH3-23__IGHD6-13*01>1'__IGHJ1*01 | 2175 | V1-3__IGLJ1*01 | 842 | 1447 |
| 2369 VH3-23__IGHD6-13*01>2'__IGHJ1*01 | 2176 | V1-3__IGLJ1*01 | 842 | 1447 |
| 2370 VH3-23__IGHD6-13*01>2'__IGHJ1*01_B | 2177 | V1-3__IGLJ1*01 | 842 | 1447 |
| 2371 VH3-23__IGHD6-19*01>1'__IGHJ1*01 | 2178 | V1-3__IGLJ1*01 | 842 | 1447 |
| 2372 VH3-23__IGHD6-19*01>2'__IGHJ1*01 | 2179 | V1-3__IGLJ1*01 | 842 | 1447 |
| 2373 VH3-23__IGHD6-19*01>2'__IGHJ1*01_B | 2180 | V1-3__IGLJ1*01 | 842 | 1447 |
| 2374 VH3-23__IGHD6-25*01>1'__IGHJ1*01 | 2181 | V1-3__IGLJ1*01 | 842 | 1447 |
| 2375 VH3-23__IGHD6-25*01>3'__IGHJ1*01 | 2182 | V1-3__IGLJ1*01 | 842 | 1447 |
| 2376 VH3-23__IGHD7-27*01>1'__IGHJ1*01_B | 2183 | V1-3__IGLJ1*01 | 842 | 1447 |
| 2377 VH3-23__IGHD7-27*01>2'__IGHJ1*01 | 2184 | V1-3__IGLJ1*01 | 842 | 1447 |
| 2378 VH3-23__IGHD6-6*01>2__IGHJ2*01 | 2233 | V1-3__IGLJ1*01 | 842 | 1447 |
| 2379 VH3-23__IGHD6-13*01>1__IGHJ2*01 | 2234 | V1-3__IGLJ1*01 | 842 | 1447 |
| 2380 VH3-23__IGHD6-13*01>2__IGHJ2*01 | 2235 | V1-3__IGLJ1*01 | 842 | 1447 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 2381 | VH3-23_IGHD6-19*01>1_IGHJ2*01 | 2236 | V1-3_IGLJ1*01 | 842 | 1447 |
| 2382 | VH3-23_IGHD6-19*01>2_IGHJ2*01 | 2237 | V1-3_IGLJ1*01 | 842 | 1447 |
| 2383 | VH3-23_IGHD6-25*01>1_IGHJ2*01 | 2238 | V1-3_IGLJ1*01 | 842 | 1447 |
| 2384 | VH3-23_IGHD6-25*01>2_IGHJ2*01 | 2239 | V1-3_IGLJ1*01 | 842 | 1447 |
| 2385 | VH3-23_IGHD7-27*01>1_IGHJ2*01 | 2240 | V1-3_IGLJ1*01 | 842 | 1447 |
| 2386 | VH3-23_IGHD7-27*01>3_IGHJ2*01 | 2241 | V1-3_IGLJ1*01 | 842 | 1447 |
| 2387 | VH3-23_IGHD6-13*01>1'_IGHJ2*01 | 2290 | V1-3_IGLJ1*01 | 842 | 1447 |
| 2388 | VH3-23_IGHD6-13*01>2'_IGHJ2*01 | 2291 | V1-3_IGLJ1*01 | 842 | 1447 |
| 2389 | VH3-23_IGHD6-13*01>2'_IGHJ2*01_B | 2292 | V1-3_IGLJ1*01 | 842 | 1447 |
| 2390 | VH3-23_IGHD6-19*01>1'_IGHJ2*01 | 2293 | V1-3_IGLJ1*01 | 842 | 1447 |
| 2391 | VH3-23_IGHD6-19*01>2'_IGHJ2*01 | 2294 | V1-3_IGLJ1*01 | 842 | 1447 |
| 2392 | VH3-23_IGHD6-19*01>2'_IGHJ2*01_B | 2295 | V1-3_IGLJ1*01 | 842 | 1447 |
| 2393 | VH3-23_IGHD6-25*01>1'_IGHJ2*01 | 2296 | V1-3_IGLJ1*01 | 842 | 1447 |
| 2394 | VH3-23_IGHD6-25*01>3'_IGHJ2*01 | 2297 | V1-3_IGLJ1*01 | 842 | 1447 |
| 2395 | VH3-23_IGHD7-27*01>1'_IGHJ2*01 | 2298 | V1-3_IGLJ1*01 | 842 | 1447 |
| 2396 | VH3-23_IGHD7-27*01>2'_IGHJ2*01 | 2299 | V1-3_IGLJ1*01 | 842 | 1447 |
| 2397 | VH3-23_IGHD6-6*01>2_IGHJ3*01 | 2348 | V1-3_IGLJ1*01 | 842 | 1447 |
| 2398 | VH3-23_IGHD6-13*01>1_IGHJ3*01 | 2349 | V1-3_IGLJ1*01 | 842 | 1447 |
| 2399 | VH3-23_IGHD6-13*01>2_IGHJ3*01 | 2350 | V1-3_IGLJ1*01 | 842 | 1447 |
| 2400 | VH3-23_IGHD6-19*01>1_IGHJ3*01 | 2351 | V1-3_IGLJ1*01 | 842 | 1447 |
| 2401 | VH3-23_IGHD6-19*01>2_IGHJ3*01 | 2352 | V1-3_IGLJ1*01 | 842 | 1447 |
| 2402 | VH3-23_IGHD6-25*01>1_IGHJ3*01 | 2353 | V1-3_IGLJ1*01 | 842 | 1447 |
| 2403 | VH3-23_IGHD6-25*01>2_IGHJ3*01 | 2354 | V1-3_IGLJ1*01 | 842 | 1447 |
| 2404 | VH3-23_IGHD7-27*01>1_IGHJ3*01 | 2355 | V1-3_IGLJ1*01 | 842 | 1447 |
| 2405 | VH3-23_IGHD7-27*01>3_IGHJ3*01 | 2356 | V1-3_IGLJ1*01 | 842 | 1447 |
| 2406 | VH3-23_IGHD6-13*01>1'_IGHJ3*01 | 2405 | V1-3_IGLJ1*01 | 842 | 1447 |
| 2407 | VH3-23_IGHD6-13*01>2'_IGHJ3*01 | 2406 | V1-3_IGLJ1*01 | 842 | 1447 |
| 2408 | VH3-23_IGHD6-13*01>1_IGHJ6*01 | 2407 | V1-3_IGLJ1*01 | 842 | 1447 |
| 2409 | VH3-23_IGHD6-19*01>1'_IGHJ3*01 | 2408 | V1-3_IGLJ1*01 | 842 | 1447 |
| 2410 | VH3-23_IGHD6-19*01>2'_IGHJ3*01 | 2409 | V1-3_IGLJ1*01 | 842 | 1447 |
| 2411 | VH3-23_IGHD6-19*01>3'_IGHJ3*01 | 2410 | V1-3_IGLJ1*01 | 842 | 1447 |
| 2412 | VH3-23_IGHD6-25*01>1'_IGHJ3*01 | 2411 | V1-3_IGLJ1*01 | 842 | 1447 |
| 2413 | VH3-23_IGHD6-25*01>3'_IGHJ3*01 | 2412 | V1-3_IGLJ1*01 | 842 | 1447 |
| 2414 | VH3-23_IGHD7-27*01>1'_IGHJ3*01 | 2413 | V1-3_IGLJ1*01 | 842 | 1447 |
| 2415 | VH3-23_IGHD7-27*01>2'_IGHJ3*01 | 2414 | V1-3_IGLJ1*01 | 842 | 1447 |
| 2416 | VH3-23_IGHD6-6*01>2_IGHJ4*01 | 2463 | V1-3_IGLJ1*01 | 842 | 1447 |
| 2417 | VH3-23_IGHD6-13*01>1_IGHJ4*01 | 2464 | V1-3_IGLJ1*01 | 842 | 1447 |
| 2418 | VH3-23_IGHD6-13*01>2_IGHJ4*01 | 2465 | V1-3_IGLJ1*01 | 842 | 1447 |
| 2419 | VH3-23_IGHD6-19*01>1_IGHJ4*01 | 2466 | V1-3_IGLJ1*01 | 842 | 1447 |
| 2420 | VH3-23_IGHD6-19*01>2_IGHJ4*01 | 2467 | V1-3_IGLJ1*01 | 842 | 1447 |
| 2421 | VH3-23_IGHD6-25*01>1_IGHJ4*01 | 2468 | V1-3_IGLJ1*01 | 842 | 1447 |
| 2422 | VH3-23_IGHD6-25*01>2_IGHJ4*01 | 2469 | V1-3_IGLJ1*01 | 842 | 1447 |
| 2423 | VH3-23_IGHD7-27*01>1_IGHJ4*01 | 2470 | V1-3_IGLJ1*01 | 842 | 1447 |
| 2424 | VH3-23_IGHD7-27*01>3_IGHJ4*01 | 2471 | V1-3_IGLJ1*01 | 842 | 1447 |
| 2425 | VH3-23_IGHD6-13*01>1'_IGHJ4*01 | 2520 | V1-3_IGLJ1*01 | 842 | 1447 |
| 2426 | VH3-23_IGHD6-13*01>2'_IGHJ4*01 | 2521 | V1-3_IGLJ1*01 | 842 | 1447 |
| 2427 | VH3-23_IGHD6-13*01>2'_IGHJ4*01_B | 2522 | V1-3_IGLJ1*01 | 842 | 1447 |
| 2428 | VH3-23_IGHD6-19*01>1'_IGHJ4*01 | 2523 | V1-3_IGLJ1*01 | 842 | 1447 |
| 2429 | VH3-23_IGHD6-19*01>2'_IGHJ4*01 | 2524 | V1-3_IGLJ1*01 | 842 | 1447 |
| 2430 | VH3-23_IGHD6-19*01>2'_IGHJ4*01_B | 2525 | V1-3_IGLJ1*01 | 842 | 1447 |
| 2431 | VH3-23_IGHD6-25*01>1'_IGHJ4*01 | 2526 | V1-3_IGLJ1*01 | 842 | 1447 |
| 2432 | VH3-23_IGHD6-25*01>3'_IGHJ4*01 | 2527 | V1-3_IGLJ1*01 | 842 | 1447 |
| 2433 | VH3-23_IGHD7-27*01>1'_IGHJ4*01 | 2528 | V1-3_IGLJ1*01 | 842 | 1447 |
| 2434 | VH3-23_IGHD7-27*01>2'_IGHJ4*01 | 2529 | V1-3_IGLJ1*01 | 842 | 1447 |
| 2435 | VH3-23_IGHD6-6*01>2_IGHJ5*01 | 2578 | V1-3_IGLJ1*01 | 842 | 1447 |
| 2436 | VH3-23_IGHD6-13*01>1_IGHJ5*01 | 2579 | V1-3_IGLJ1*01 | 842 | 1447 |
| 2437 | VH3-23_IGHD6-13*01>2_IGHJ5*01 | 2580 | V1-3_IGLJ1*01 | 842 | 1447 |
| 2438 | VH3-23_IGHD6-19*01>1_IGHJ5*01 | 2581 | V1-3_IGLJ1*01 | 842 | 1447 |
| 2439 | VH3-23_IGHD6-19*01>2_IGHJ5*01 | 2582 | V1-3_IGLJ1*01 | 842 | 1447 |
| 2440 | VH3-23_IGHD6-25*01>1_IGHJ5*01 | 2583 | V1-3_IGLJ1*01 | 842 | 1447 |
| 2441 | VH3-23_IGHD6-25*01>2_IGHJ5*01 | 2584 | V1-3_IGLJ1*01 | 842 | 1447 |
| 2442 | VH3-23_IGHD7-27*01>1_IGHJ5*01 | 2585 | V1-3_IGLJ1*01 | 842 | 1447 |
| 2443 | VH3-23_IGHD7-27*01>3_IGHJ5*01 | 2586 | V1-3_IGLJ1*01 | 842 | 1447 |
| 2444 | VH3-23_IGHD6-13*01>1'_IGHJ5*01 | 2635 | V1-3_IGLJ1*01 | 842 | 1447 |
| 2445 | VH3-23_IGHD6-13*01>2'_IGHJ5*01 | 2636 | V1-3_IGLJ1*01 | 842 | 1447 |
| 2446 | VH3-23_IGHD6-13*01>3'_IGHJ5*01 | 2637 | V1-3_IGLJ1*01 | 842 | 1447 |
| 2447 | VH3-23_IGHD6-19*01>1'_IGHJ5*01 | 2638 | V1-3_IGLJ1*01 | 842 | 1447 |
| 2448 | VH3-23_IGHD6-19*01>2'_IGHJ5*01 | 2639 | V1-3_IGLJ1*01 | 842 | 1447 |
| 2449 | VH3-23_IGHD6-19*01>2'_IGHJ5*01_B | 2640 | V1-3_IGLJ1*01 | 842 | 1447 |
| 2450 | VH3-23_IGHD6-25*01>1'_IGHJ5*01 | 2641 | V1-3_IGLJ1*01 | 842 | 1447 |
| 2451 | VH3-23_IGHD6-25*01>3'_IGHJ5*01 | 2642 | V1-3_IGLJ1*01 | 842 | 1447 |
| 2452 | VH3-23_IGHD7-27*01>1'_IGHJ5*01 | 2643 | V1-3_IGLJ1*01 | 842 | 1447 |
| 2453 | VH3-23_IGHD7-27*01>2'_IGHJ5*01 | 2644 | V1-3_IGLJ1*01 | 842 | 1447 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 2454 | VH3-23_IGHD6-6*01>2_IGHJ6*01 | 2693 | V1-3_IGLJ1*01 | 842 | 1447 |
| 2455 | VH3-23_IGHD1-1*01>1_IGHJ6*01 | 2645 | V2-13_IGLJ2*01 | 849 | 1454 |
| 2456 | VH3-23_IGHD1-1*01>2_IGHJ6*01 | 2646 | V2-13_IGLJ2*01 | 849 | 1454 |
| 2457 | VH3-23_IGHD1-1*01>3_IGHJ6*01 | 2647 | V2-13_IGLJ2*01 | 849 | 1454 |
| 2458 | VH3-23_IGHD1-7*01>1_IGHJ6*01 | 2648 | V2-13_IGLJ2*01 | 849 | 1454 |
| 2459 | VH3-23_IGHD1-7*01>3_IGHJ6*01 | 2649 | V2-13_IGLJ2*01 | 849 | 1454 |
| 2460 | VH3-23_IGHD1-14*01>1_IGHJ6*01 | 2650 | V2-13_IGLJ2*01 | 849 | 1454 |
| 2461 | VH3-23_IGHD1-14*01>3_IGHJ6*01 | 2651 | V2-13_IGLJ2*01 | 849 | 1454 |
| 2462 | VH3-23_IGHD1-20*01>1_IGHJ6*01 | 2652 | V2-13_IGLJ2*01 | 849 | 1454 |
| 2463 | VH3-23_IGHD1-20*01>3_IGHJ6*01 | 2653 | V2-13_IGLJ2*01 | 849 | 1454 |
| 2464 | VH3-23_IGHD1-26*01>1_IGHJ6*01 | 2654 | V2-13_IGLJ2*01 | 849 | 1454 |
| 2465 | VH3-23_IGHD1-26*01>3_IGHJ6*01 | 2655 | V2-13_IGLJ2*01 | 849 | 1454 |
| 2466 | VH3-23_IGHD2-2*01>2_IGHJ6*01 | 2656 | V2-13_IGLJ2*01 | 849 | 1454 |
| 2467 | VH3-23_IGHD2-2*01>3_IGHJ6*01 | 2657 | V2-13_IGLJ2*01 | 849 | 1454 |
| 2468 | VH3-23_IGHD2-8*01>2_IGHJ6*01 | 2658 | V2-13_IGLJ2*01 | 849 | 1454 |
| 2469 | VH3-23_IGHD2-8*01>3_IGHJ6*01 | 2659 | V2-13_IGLJ2*01 | 849 | 1454 |
| 2470 | VH3-23_IGHD2-15*01>2_IGHJ6*01 | 2660 | V2-13_IGLJ2*01 | 849 | 1454 |
| 2471 | VH3-23_IGHD2-15*01>3_IGHJ6*01 | 2661 | V2-13_IGLJ2*01 | 849 | 1454 |
| 2472 | VH3-23_IGHD2-21*01>2_IGHJ6*01 | 2662 | V2-13_IGLJ2*01 | 849 | 1454 |
| 2473 | VH3-23_IGHD2-21*01>3_IGHJ6*01 | 2663 | V2-13_IGLJ2*01 | 849 | 1454 |
| 2474 | VH3-23_IGHD3-3*01>1_IGHJ6*01 | 2664 | V2-13_IGLJ2*01 | 849 | 1454 |
| 2475 | VH3-23_IGHD3-3*01>2_IGHJ6*01 | 2665 | V2-13_IGLJ2*01 | 849 | 1454 |
| 2476 | VH3-23_IGHD3-3*01>3_IGHJ6*01 | 2666 | V2-13_IGLJ2*01 | 849 | 1454 |
| 2477 | VH3-23_IGHD3-9*01>2_IGHJ6*01 | 2667 | V2-13_IGLJ2*01 | 849 | 1454 |
| 2478 | VH3-23_IGHD3-10*01>2_IGHJ6*01 | 2668 | V2-13_IGLJ2*01 | 849 | 1454 |
| 2479 | VH3-23_IGHD3-10*01>3_IGHJ6*01 | 2669 | V2-13_IGLJ2*01 | 849 | 1454 |
| 2480 | VH3-23_IGHD3-16*01>2_IGHJ6*01 | 2670 | V2-13_IGLJ2*01 | 849 | 1454 |
| 2481 | VH3-23_IGHD3-16*01>3_IGHJ6*01 | 2671 | V2-13_IGLJ2*01 | 849 | 1454 |
| 2482 | VH3-23_IGHD3-22*01>2_IGHJ6*01 | 2672 | V2-13_IGLJ2*01 | 849 | 1454 |
| 2483 | VH3-23_IGHD3-22*01>3_IGHJ6*01 | 2673 | V2-13_IGLJ2*01 | 849 | 1454 |
| 2484 | VH3-23_IGHD4-4*01 (1) >2_IGHJ6*01 | 2674 | V2-13_IGLJ2*01 | 849 | 1454 |
| 2485 | VH3-23_IGHD4-4*01 (1) >3_IGHJ6*01 | 2675 | V2-13_IGLJ2*01 | 849 | 1454 |
| 2486 | VH3-23_IGHD4-11*01 (1) >2_IGHJ6*01 | 2676 | V2-13_IGLJ2*01 | 849 | 1454 |
| 2487 | VH3-23_IGHD4-11*01 (1) >3_IGHJ6*01 | 2677 | V2-13_IGLJ2*01 | 849 | 1454 |
| 2488 | VH3-23_IGHD4-17*01>2_IGHJ6*01 | 2678 | V2-13_IGLJ2*01 | 849 | 1454 |
| 2489 | VH3-23_IGHD4-17*01>3_IGHJ6*01 | 2679 | V2-13_IGLJ2*01 | 849 | 1454 |
| 2490 | VH3-23_IGHD4-23*01>2_IGHJ6*01 | 2680 | V2-13_IGLJ2*01 | 849 | 1454 |
| 2491 | VH3-23_IGHD4-23*01>3_IGHJ6*01 | 2681 | V2-13_IGLJ2*01 | 849 | 1454 |
| 2492 | VH3-23_IGHD5-5*01 (2) >1_IGHJ6*01 | 2682 | V2-13_IGLJ2*01 | 849 | 1454 |
| 2493 | VH3-23_IGHD5-5*01 (2) >2_IGHJ6*01 | 2683 | V2-13_IGLJ2*01 | 849 | 1454 |
| 2494 | VH3-23_IGHD5-5*01 (2) >3_IGHJ6*01 | 2684 | V2-13_IGLJ2*01 | 849 | 1454 |
| 2495 | VH3-23_IGHD5-12*01>1_IGHJ6*01 | 2685 | V2-13_IGLJ2*01 | 849 | 1454 |
| 2496 | VH3-23_IGHD5-12*01>3_IGHJ6*01 | 2686 | V2-13_IGLJ2*01 | 849 | 1454 |
| 2497 | VH3-23_IGHD5-18*01 (2) >1_IGHJ6*01 | 2687 | V2-13_IGLJ2*01 | 849 | 1454 |
| 2498 | VH3-23_IGHD5-18*01 (2) >2_IGHJ6*01 | 2688 | V2-13_IGLJ2*01 | 849 | 1454 |
| 2499 | VH3-23_IGHD5-18*01 (2) >3_IGHJ6*01 | 2689 | V2-13_IGLJ2*01 | 849 | 1454 |
| 2500 | VH3-23_IGHD5-24*01>1_IGHJ6*01 | 2690 | V2-13_IGLJ2*01 | 849 | 1454 |
| 2501 | VH3-23_IGHD5-24*01>3_IGHJ6*01 | 2691 | V2-13_IGLJ2*01 | 849 | 1454 |
| 2502 | VH3-23_IGHD6-6*01>1_IGHJ6*01 | 2692 | V2-13_IGLJ2*01 | 849 | 1454 |
| 2503 | VH3-23_IGHD1-1*01>1'_IGHJ6*01 | 2702 | V2-13_IGLJ2*01 | 849 | 1454 |
| 2504 | VH3-23_IGHD1-1*01>2'_IGHJ6*01 | 2703 | V2-13_IGLJ2*01 | 849 | 1454 |
| 2505 | VH3-23_IGHD1-1*01>3'_IGHJ6*01 | 2704 | V2-13_IGLJ2*01 | 849 | 1454 |
| 2506 | VH3-23_IGHD1-7*01>1'_IGHJ6*01 | 2705 | V2-13_IGLJ2*01 | 849 | 1454 |
| 2507 | VH3-23_IGHD1-7*01>3'_IGHJ6*01 | 2706 | V2-13_IGLJ2*01 | 849 | 1454 |
| 2508 | VH3-23_IGHD1-14*01>1'_IGHJ6*01 | 2707 | V2-13_IGLJ2*01 | 849 | 1454 |
| 2509 | VH3-23_IGHD1-14*01>2'_IGHJ6*01 | 2708 | V2-13_IGLJ2*01 | 849 | 1454 |
| 2510 | VH3-23_IGHD1-14*01>3'_IGHJ6*01 | 2709 | V2-13_IGLJ2*01 | 849 | 1454 |
| 2511 | VH3-23_IGHD1-20*01>1'_IGHJ6*01 | 2710 | V2-13_IGLJ2*01 | 849 | 1454 |
| 2512 | VH3-23_IGHD1-20*01>2'_IGHJ6*01 | 2711 | V2-13_IGLJ2*01 | 849 | 1454 |
| 2513 | VH3-23_IGHD1-20*01>3'_IGHJ6*01 | 2712 | V2-13_IGLJ2*01 | 849 | 1454 |
| 2514 | VH3-23_IGHD1-26*01>1'_IGHJ6*01 | 2713 | V2-13_IGLJ2*01 | 849 | 1454 |
| 2515 | VH3-23_IGHD1-26*01>1'_IGHJ6*01_B | 2714 | V2-13_IGLJ2*01 | 849 | 1454 |
| 2516 | VH3-23_IGHD2-2*01>2'_IGHJ6*01_B | 2715 | V2-13_IGLJ2*01 | 849 | 1454 |
| 2517 | VH3-23_IGHD2-2*01>3'_IGHJ6*01 | 2716 | V2-13_IGLJ2*01 | 849 | 1454 |
| 2518 | VH3-23_IGHD2-8*01>1'_IGHJ6*01 | 2717 | V2-13_IGLJ2*01 | 849 | 1454 |
| 2519 | VH3-23_IGHD2-15*01>1'_IGHJ6*01 | 2718 | V2-13_IGLJ2*01 | 849 | 1454 |
| 2520 | VH3-23_IGHD2-15*01>3'_IGHJ6*01 | 2719 | V2-13_IGLJ2*01 | 849 | 1454 |
| 2521 | VH3-23_IGHD2-21*01>1'_IGHJ6*01 | 2720 | V2-13_IGLJ2*01 | 849 | 1454 |
| 2522 | VH3-23_IGHD2-21*01>3'_IGHJ6*01 | 2721 | V2-13_IGLJ2*01 | 849 | 1454 |
| 2523 | VH3-23_IGHD3-3*01>1'_IGHJ6*01 | 2722 | V2-13_IGLJ2*01 | 849 | 1454 |
| 2524 | VH3-23_IGHD3-3*01>3'_IGHJ6*01 | 2723 | V2-13_IGLJ2*01 | 849 | 1454 |
| 2525 | VH3-23_IGHD3-9*01>1'_IGHJ6*01 | 2724 | V2-13_IGLJ2*01 | 849 | 1454 |
| 2526 | VH3-23_IGHD3-9*01>3'_IGHJ6*01 | 2725 | V2-13_IGLJ2*01 | 849 | 1454 |

TABLE 17A-continued

Exemplary Nucleic Acid Paired Library

| HEAVY CHAIN Name | RS SEQ ID NO | LIGHT CHAIN Name | RS SEQ ID NO | NO RS SEQ ID NO |
|---|---|---|---|---|
| 2527 VH3-23__IGHD3-10*01>1'__IGHJ6*01 | 2726 | V2-13__IGLJ2*01 | 849 | 1454 |
| 2528 VH3-23__IGHD3-10*01>3'__IGHJ6*01 | 2727 | V2-13__IGLJ2*01 | 849 | 1454 |
| 2529 VH3-23__IGHD3-16*01>1'__IGHJ6*01 | 2728 | V2-13__IGLJ2*01 | 849 | 1454 |
| 2530 VH3-23__IGHD3-16*01>3'__IGHJ6*01 | 2729 | V2-13__IGLJ2*01 | 849 | 1454 |
| 2531 VH3-23__IGHD3-22*01>1'__IGHJ6*01 | 2730 | V2-13__IGLJ2*01 | 849 | 1454 |
| 2532 VH3-23__IGHD4-4*01 (1) >1'__IGHJ6*01 | 2731 | V2-13__IGLJ2*01 | 849 | 1454 |
| 2533 VH3-23__IGHD4-4*01 (1) >3'__IGHJ6*01 | 2732 | V2-13__IGLJ2*01 | 849 | 1454 |
| 2534 VH3-23__IGHD4-11*01 (1) >1'__IGHJ6*01 | 2733 | V2-13__IGLJ2*01 | 849 | 1454 |
| 2535 VH3-23__IGHD4-11*01 (1) >3'__IGHJ6*01 | 2734 | V2-13__IGLJ2*01 | 849 | 1454 |
| 2536 VH3-23__IGHD4-17*01>1'__IGHJ6*01 | 2735 | V2-13__IGLJ2*01 | 849 | 1454 |
| 2537 VH3-23__IGHD4-17*01>3'__IGHJ6*01 | 2736 | V2-13__IGLJ2*01 | 849 | 1454 |
| 2538 VH3-23__IGHD4-23*01>1'__IGHJ6*01 | 2737 | V2-13__IGLJ2*01 | 849 | 1454 |
| 2539 VH3-23__IGHD4-23*01>3'__IGHJ6*01 | 2738 | V2-13__IGLJ2*01 | 849 | 1454 |
| 2540 VH3-23__IGHD5-5*01 (2) >1'__IGHJ6*01 | 2739 | V2-13__IGLJ2*01 | 849 | 1454 |
| 2541 VH3-23__IGHD5-5*01 (2) >3'__IGHJ6*01 | 2740 | V2-13__IGLJ2*01 | 849 | 1454 |
| 2542 VH3-23__IGHD5-12*01>1'__IGHJ6*01 | 2741 | V2-13__IGLJ2*01 | 849 | 1454 |
| 2543 VH3-23__IGHD5-12*01>3'__IGHJ6*01 | 2742 | V2-13__IGLJ2*01 | 849 | 1454 |
| 2544 VH3-23__IGHD5-18*01 (2) >1'__IGHJ6*01 | 2743 | V2-13__IGLJ2*01 | 849 | 1454 |
| 2545 VH3-23__IGHD5-18*01 (2) >3'__IGHJ6*01 | 2744 | V2-13__IGLJ2*01 | 849 | 1454 |
| 2546 VH3-23__IGHD5-24*01>1'__IGHJ6*01 | 2745 | V2-13__IGLJ2*01 | 849 | 1454 |
| 2547 VH3-23__IGHD5-24*01>3'__IGHJ6*01 | 2746 | V2-13__IGLJ2*01 | 849 | 1454 |
| 2548 VH3-23__IGHD6-6*01>1'__IGHJ6*01 | 2747 | V2-13__IGLJ2*01 | 849 | 1454 |
| 2549 VH3-23__IGHD6-6*01>2'__IGHJ6*01 | 2748 | V2-13__IGLJ2*01 | 849 | 1454 |
| 2550 VH3-23__IGHD6-6*01>3'__IGHJ6*01 | 2749 | V2-13__IGLJ2*01 | 849 | 1454 |
| 2551 VH3-23__IGHD1-1*01>1__IGHJ6*01 | 2645 | V2-14__IGLJ4*01 | 850 | 1455 |
| 2552 VH3-23__IGHD1-1*01>2__IGHJ6*01 | 2646 | V2-14__IGLJ4*01 | 850 | 1455 |
| 2553 VH3-23__IGHD1-1*01>3__IGHJ6*01 | 2647 | V2-14__IGLJ4*01 | 850 | 1455 |
| 2554 VH3-23__IGHD1-7*01>1__IGHJ6*01 | 2648 | V2-14__IGLJ4*01 | 850 | 1455 |
| 2555 VH3-23__IGHD1-7*01>3__IGHJ6*01 | 2649 | V2-14__IGLJ4*01 | 850 | 1455 |
| 2556 VH3-23__IGHD1-14*01>1__IGHJ6*01 | 2650 | V2-14__IGLJ4*01 | 850 | 1455 |
| 2557 VH3-23__IGHD1-14*01>3__IGHJ6*01 | 2651 | V2-14__IGLJ4*01 | 850 | 1455 |
| 2558 VH3-23__IGHD1-20*01>1__IGHJ6*01 | 2652 | V2-14__IGLJ4*01 | 850 | 1455 |
| 2559 VH3-23__IGHD1-20*01>3__IGHJ6*01 | 2653 | V2-14__IGLJ4*01 | 850 | 1455 |
| 2560 VH3-23__IGHD1-26*01>1__IGHJ6*01 | 2654 | V2-14__IGLJ4*01 | 850 | 1455 |
| 2561 VH3-23__IGHD1-26*01>3__IGHJ6*01 | 2655 | V2-14__IGLJ4*01 | 850 | 1455 |
| 2562 VH3-23__IGHD2-2*01>2__IGHJ6*01 | 2656 | V2-14__IGLJ4*01 | 850 | 1455 |
| 2563 VH3-23__IGHD2-2*01>3__IGHJ6*01 | 2657 | V2-14__IGLJ4*01 | 850 | 1455 |
| 2564 VH3-23__IGHD2-8*01>2__IGHJ6*01 | 2658 | V2-14__IGLJ4*01 | 850 | 1455 |
| 2565 VH3-23__IGHD2-8*01>3__IGHJ6*01 | 2659 | V2-14__IGLJ4*01 | 850 | 1455 |
| 2566 VH3-23__IGHD2-15*01>2__IGHJ6*01 | 2660 | V2-14__IGLJ4*01 | 850 | 1455 |
| 2567 VH3-23__IGHD2-15*01>3__IGHJ6*01 | 2661 | V2-14__IGLJ4*01 | 850 | 1455 |
| 2568 VH3-23__IGHD2-21*01>2__IGHJ6*01 | 2662 | V2-14__IGLJ4*01 | 850 | 1455 |
| 2569 VH3-23__IGHD2-21*01>3__IGHJ6*01 | 2663 | V2-14__IGLJ4*01 | 850 | 1455 |
| 2570 VH3-23__IGHD3-3*01>1__IGHJ6*01 | 2664 | V2-14__IGLJ4*01 | 850 | 1455 |
| 2571 VH3-23__IGHD3-3*01>2__IGHJ6*01 | 2665 | V2-14__IGLJ4*01 | 850 | 1455 |
| 2572 VH3-23__IGHD3-3*01>3__IGHJ6*01 | 2666 | V2-14__IGLJ4*01 | 850 | 1455 |
| 2573 VH3-23__IGHD3-9*01>2__IGHJ6*01 | 2667 | V2-14__IGLJ4*01 | 850 | 1455 |
| 2574 VH3-23__IGHD3-10*01>2__IGHJ6*01 | 2668 | V2-14__IGLJ4*01 | 850 | 1455 |
| 2575 VH3-23__IGHD3-10*01>3__IGHJ6*01 | 2669 | V2-14__IGLJ4*01 | 850 | 1455 |
| 2576 VH3-23__IGHD3-16*01>2__IGHJ6*01 | 2670 | V2-14__IGLJ4*01 | 850 | 1455 |
| 2577 VH3-23__IGHD3-16*01>3__IGHJ6*01 | 2671 | V2-14__IGLJ4*01 | 850 | 1455 |
| 2578 VH3-23__IGHD3-22*01>2__IGHJ6*01 | 2672 | V2-14__IGLJ4*01 | 850 | 1455 |
| 2579 VH3-23__IGHD3-22*01>3__IGHJ6*01 | 2673 | V2-14__IGLJ4*01 | 850 | 1455 |
| 2580 VH3-23__IGHD4-4*01 (1) >2__IGHJ6*01 | 2674 | V2-14__IGLJ4*01 | 850 | 1455 |
| 2581 VH3-23__IGHD4-4*01 (1) >3__IGHJ6*01 | 2675 | V2-14__IGLJ4*01 | 850 | 1455 |
| 2582 VH3-23__IGHD4-11*01 (1) >2__IGHJ6*01 | 2676 | V2-14__IGLJ4*01 | 850 | 1455 |
| 2583 VH3-23__IGHD4-11*01 (1) >3__IGHJ6*01 | 2677 | V2-14__IGLJ4*01 | 850 | 1455 |
| 2584 VH3-23__IGHD4-17*01>2__IGHJ6*01 | 2678 | V2-14__IGLJ4*01 | 850 | 1455 |
| 2585 VH3-23__IGHD4-17*01>3__IGHJ6*01 | 2679 | V2-14__IGLJ4*01 | 850 | 1455 |
| 2586 VH3-23__IGHD4-23*01>2__IGHJ6*01 | 2680 | V2-14__IGLJ4*01 | 850 | 1455 |
| 2587 VH3-23__IGHD4-23*01>3__IGHJ6*01 | 2681 | V2-14__IGLJ4*01 | 850 | 1455 |
| 2588 VH3-23__IGHD5-5*01 (2) >1__IGHJ6*01 | 2682 | V2-14__IGLJ4*01 | 850 | 1455 |
| 2589 VH3-23__IGHD5-5*01 (2) >2__IGHJ6*01 | 2683 | V2-14__IGLJ4*01 | 850 | 1455 |
| 2590 VH3-23__IGHD5-5*01 (2) >3__IGHJ6*01 | 2684 | V2-14__IGLJ4*01 | 850 | 1455 |
| 2591 VH3-23__IGHD5-12*01>1__IGHJ6*01 | 2685 | V2-14__IGLJ4*01 | 850 | 1455 |
| 2592 VH3-23__IGHD5-12*01>3__IGHJ6*01 | 2686 | V2-14__IGLJ4*01 | 850 | 1455 |
| 2593 VH3-23__IGHD5-18*01 (2) >1__IGHJ6*01 | 2687 | V2-14__IGLJ4*01 | 850 | 1455 |
| 2594 VH3-23__IGHD5-18*01 (2) >2__IGHJ6*01 | 2688 | V2-14__IGLJ4*01 | 850 | 1455 |
| 2595 VH3-23__IGHD5-18*01 (2) >3__IGHJ6*01 | 2689 | V2-14__IGLJ4*01 | 850 | 1455 |
| 2596 VH3-23__IGHD5-24*01>1__IGHJ6*01 | 2690 | V2-14__IGLJ4*01 | 850 | 1455 |
| 2597 VH3-23__IGHD5-24*01>3__IGHJ6*01 | 2691 | V2-14__IGLJ4*01 | 850 | 1455 |
| 2598 VH3-23__IGHD6-6*01>1__IGHJ6*01 | 2692 | V2-14__IGLJ4*01 | 850 | 1455 |
| 2599 VH3-23__IGHD1-1*01>1'__IGHJ6*01 | 2702 | V2-14__IGLJ4*01 | 850 | 1455 |

TABLE 17A-continued

Exemplary Nucleic Acid Paired Library

| HEAVY CHAIN Name | RS SEQ ID NO | LIGHT CHAIN Name | RS SEQ ID NO | NO RS SEQ ID NO |
|---|---|---|---|---|
| 2600 VH3-23_IGHD1-1*01>2'_IGHJ6*01 | 2703 | V2-14_IGLJ4*01 | 850 | 1455 |
| 2601 VH3-23_IGHD1-1*01>3'_IGHJ6*01 | 2704 | V2-14_IGLJ4*01 | 850 | 1455 |
| 2602 VH3-23_IGHD1-7*01>1'_IGHJ6*01 | 2705 | V2-14_IGLJ4*01 | 850 | 1455 |
| 2603 VH3-23_IGHD1-7*01>3'_IGHJ6*01 | 2706 | V2-14_IGLJ4*01 | 850 | 1455 |
| 2604 VH3-23_IGHD1-14*01>1'_IGHJ6*01 | 2707 | V2-14_IGLJ4*01 | 850 | 1455 |
| 2605 VH3-23_IGHD1-14*01>2'_IGHJ6*01 | 2708 | V2-14_IGLJ4*01 | 850 | 1455 |
| 2606 VH3-23_IGHD1-14*01>3'_IGHJ6*01 | 2709 | V2-14_IGLJ4*01 | 850 | 1455 |
| 2607 VH3-23_IGHD1-20*01>1'_IGHJ6*01 | 2710 | V2-14_IGLJ4*01 | 850 | 1455 |
| 2608 VH3-23_IGHD1-20*01>2'_IGHJ6*01 | 2711 | V2-14_IGLJ4*01 | 850 | 1455 |
| 2609 VH3-23_IGHD1-20*01>3'_IGHJ6*01 | 2712 | V2-14_IGLJ4*01 | 850 | 1455 |
| 2610 VH3-23_IGHD1-26*01>1'_IGHJ6*01 | 2713 | V2-14_IGLJ4*01 | 850 | 1455 |
| 2611 VH3-23_IGHD1-26*01>1_IGHJ6*01_B | 2714 | V2-14_IGLJ4*01 | 850 | 1455 |
| 2612 VH3-23_IGHD2-2*01>2_IGHJ6*01_B | 2715 | V2-14_IGLJ4*01 | 850 | 1455 |
| 2613 VH3-23_IGHD2-2*01>3'_IGHJ6*01 | 2716 | V2-14_IGLJ4*01 | 850 | 1455 |
| 2614 VH3-23_IGHD2-8*01>1'_IGHJ6*01 | 2717 | V2-14_IGLJ4*01 | 850 | 1455 |
| 2615 VH3-23_IGHD2-15*01>1'_IGHJ6*01 | 2718 | V2-14_IGLJ4*01 | 850 | 1455 |
| 2616 VH3-23_IGHD2-15*01>3'_IGHJ6*01 | 2719 | V2-14_IGLJ4*01 | 850 | 1455 |
| 2617 VH3-23_IGHD2-21*01>1'_IGHJ6*01 | 2720 | V2-14_IGLJ4*01 | 850 | 1455 |
| 2618 VH3-23_IGHD2-21*01>3'_IGHJ6*01 | 2721 | V2-14_IGLJ4*01 | 850 | 1455 |
| 2619 VH3-23_IGHD3-3*01>1'_IGHJ6*01 | 2722 | V2-14_IGLJ4*01 | 850 | 1455 |
| 2620 VH3-23_IGHD3-3*01>3'_IGHJ6*01 | 2723 | V2-14_IGLJ4*01 | 850 | 1455 |
| 2621 VH3-23_IGHD3-9*01>1'_IGHJ6*01 | 2724 | V2-14_IGLJ4*01 | 850 | 1455 |
| 2622 VH3-23_IGHD3-9*01>3'_IGHJ6*01 | 2725 | V2-14_IGLJ4*01 | 850 | 1455 |
| 2623 VH3-23_IGHD3-10*01>1'_IGHJ6*01 | 2726 | V2-14_IGLJ4*01 | 850 | 1455 |
| 2624 VH3-23_IGHD3-10*01>3'_IGHJ6*01 | 2727 | V2-14_IGLJ4*01 | 850 | 1455 |
| 2625 VH3-23_IGHD3-16*01>1'_IGHJ6*01 | 2728 | V2-14_IGLJ4*01 | 850 | 1455 |
| 2626 VH3-23_IGHD3-16*01>3'_IGHJ6*01 | 2729 | V2-14_IGLJ4*01 | 850 | 1455 |
| 2627 VH3-23_IGHD3-22*01>1'_IGHJ6*01 | 2730 | V2-14_IGLJ4*01 | 850 | 1455 |
| 2628 VH3-23_IGHD4-4*01 (1) >1'_IGHJ6*01 | 2731 | V2-14_IGLJ4*01 | 850 | 1455 |
| 2629 VH3-23_IGHD4-4*01 (1) >3'_IGHJ6*01 | 2732 | V2-14_IGLJ4*01 | 850 | 1455 |
| 2630 VH3-23_IGHD4-11*01 (1) >1'_IGHJ6*01 | 2733 | V2-14_IGLJ4*01 | 850 | 1455 |
| 2631 VH3-23_IGHD4-11*01 (1) >3'_IGHJ6*01 | 2734 | V2-14_IGLJ4*01 | 850 | 1455 |
| 2632 VH3-23_IGHD4-17*01>1'_IGHJ6*01 | 2735 | V2-14_IGLJ4*01 | 850 | 1455 |
| 2633 VH3-23_IGHD4-17*01>3'_IGHJ6*01 | 2736 | V2-14_IGLJ4*01 | 850 | 1455 |
| 2634 VH3-23_IGHD4-23*01>1'_IGHJ6*01 | 2737 | V2-14_IGLJ4*01 | 850 | 1455 |
| 2635 VH3-23_IGHD4-23*01>3'_IGHJ6*01 | 2738 | V2-14_IGLJ4*01 | 850 | 1455 |
| 2636 VH3-23_IGHD5-5*01 (2) >1'_IGHJ6*01 | 2739 | V2-14_IGLJ4*01 | 850 | 1455 |
| 2637 VH3-23_IGHD5-5*01 (2) >3'_IGHJ6*01 | 2740 | V2-14_IGLJ4*01 | 850 | 1455 |
| 2638 VH3-23_IGHD5-12*01>1'_IGHJ6*01 | 2741 | V2-14_IGLJ4*01 | 850 | 1455 |
| 2639 VH3-23_IGHD5-12*01>3'_IGHJ6*01 | 2742 | V2-14_IGLJ4*01 | 850 | 1455 |
| 2640 VH3-23_IGHD5-18*01 (2) >1'_IGHJ6*01 | 2743 | V2-14_IGLJ4*01 | 850 | 1455 |
| 2641 VH3-23_IGHD5-18*01 (2) >3'_IGHJ6*01 | 2744 | V2-14_IGLJ4*01 | 850 | 1455 |
| 2642 VH3-23_IGHD5-24*01>1'_IGHJ6*01 | 2745 | V2-14_IGLJ4*01 | 850 | 1455 |
| 2643 VH3-23_IGHD5-24*01>3'_IGHJ6*01 | 2746 | V2-14_IGLJ4*01 | 850 | 1455 |
| 2644 VH3-23_IGHD6-6*01>1'_IGHJ6*01 | 2747 | V2-14_IGLJ4*01 | 850 | 1455 |
| 2645 VH3-23_IGHD6-6*01>2'_IGHJ6*01 | 2748 | V2-14_IGLJ4*01 | 850 | 1455 |
| 2646 VH3-23_IGHD6-6*01>3'_IGHJ6*01 | 2749 | V2-14_IGLJ4*01 | 850 | 1455 |
| 2647 VH3-23_IGHD1-1*01>1_IGHJ6*01 | 2645 | V2-15_IGLJ7*01 | 850 | 1455 |
| 2648 VH3-23_IGHD1-1*01>2_IGHJ6*01 | 2646 | V2-15_IGLJ7*01 | 851 | 1456 |
| 2649 VH3-23_IGHD1-1*01>3_IGHJ6*01 | 2647 | V2-15_IGLJ7*01 | 851 | 1456 |
| 2650 VH3-23_IGHD1-7*01>1_IGHJ6*01 | 2648 | V2-15_IGLJ7*01 | 851 | 1456 |
| 2651 VH3-23_IGHD1-7*01>3_IGHJ6*01 | 2649 | V2-15_IGLJ7*01 | 851 | 1456 |
| 2652 VH3-23_IGHD1-14*01>1_IGHJ6*01 | 2650 | V2-15_IGLJ7*01 | 851 | 1456 |
| 2653 VH3-23_IGHD1-14*01>3_IGHJ6*01 | 2651 | V2-15_IGLJ7*01 | 851 | 1456 |
| 2654 VH3-23_IGHD1-20*01>1_IGHJ6*01 | 2652 | V2-15_IGLJ7*01 | 851 | 1456 |
| 2655 VH3-23_IGHD1-20*01>3_IGHJ6*01 | 2653 | V2-15_IGLJ7*01 | 851 | 1456 |
| 2656 VH3-23_IGHD1-26*01>1_IGHJ6*01 | 2654 | V2-15_IGLJ7*01 | 851 | 1456 |
| 2657 VH3-23_IGHD1-26*01>3_IGHJ6*01 | 2655 | V2-15_IGLJ7*01 | 851 | 1456 |
| 2658 VH3-23_IGHD2-2*01>2_IGHJ6*01 | 2656 | V2-15_IGLJ7*01 | 851 | 1456 |
| 2659 VH3-23_IGHD2-2*01>3_IGHJ6*01 | 2657 | V2-15_IGLJ7*01 | 851 | 1456 |
| 2660 VH3-23_IGHD2-8*01>2_IGHJ6*01 | 2658 | V2-15_IGLJ7*01 | 851 | 1456 |
| 2661 VH3-23_IGHD2-8*01>3_IGHJ6*01 | 2659 | V2-15_IGLJ7*01 | 851 | 1456 |
| 2662 VH3-23_IGHD2-15*01>2_IGHJ6*01 | 2660 | V2-15_IGLJ7*01 | 851 | 1456 |
| 2663 VH3-23_IGHD2-15*01>3_IGHJ6*01 | 2661 | V2-15_IGLJ7*01 | 851 | 1456 |
| 2664 VH3-23_IGHD2-21*01>2_IGHJ6*01 | 2662 | V2-15_IGLJ7*01 | 851 | 1456 |
| 2665 VH3-23_IGHD2-21*01>3_IGHJ6*01 | 2663 | V2-15_IGLJ7*01 | 851 | 1456 |
| 2666 VH3-23_IGHD3-3*01>1_IGHJ6*01 | 2664 | V2-15_IGLJ7*01 | 851 | 1456 |
| 2667 VH3-23_IGHD3-3*01>2_IGHJ6*01 | 2665 | V2-15_IGLJ7*01 | 851 | 1456 |
| 2668 VH3-23_IGHD3-3*01>3_IGHJ6*01 | 2666 | V2-15_IGLJ7*01 | 851 | 1456 |
| 2669 VH3-23_IGHD3-9*01>2_IGHJ6*01 | 2667 | V2-15_IGLJ7*01 | 851 | 1456 |
| 2670 VH3-23_IGHD3-10*01>2_IGHJ6*01 | 2668 | V2-15_IGLJ7*01 | 851 | 1456 |
| 2671 VH3-23_IGHD3-10*01>3_IGHJ6*01 | 2669 | V2-15_IGLJ7*01 | 851 | 1456 |
| 2672 VH3-23_IGHD3-16*01>2_IGHJ6*01 | 2670 | V2-15_IGLJ7*01 | 851 | 1456 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 2673 | VH3-23__IGHD3-16*01>3__IGHJ6*01 | 2671 | V2-15__IGLJ7*01 | 851 | 1456 |
| 2674 | VH3-23__IGHD3-22*01>2__IGHJ6*01 | 2672 | V2-15__IGLJ7*01 | 851 | 1456 |
| 2675 | VH3-23__IGHD3-22*01>3__IGHJ6*01 | 2673 | V2-15__IGLJ7*01 | 851 | 1456 |
| 2676 | VH3-23__IGHD4-4*01 (1) >2__IGHJ6*01 | 2674 | V2-15__IGLJ7*01 | 851 | 1456 |
| 2677 | VH3-23__IGHD4-4*01 (1) >3__IGHJ6*01 | 2675 | V2-15__IGLJ7*01 | 851 | 1456 |
| 2678 | VH3-23__IGHD4-11*01 (1) >2__IGHJ6*01 | 2676 | V2-15__IGLJ7*01 | 851 | 1456 |
| 2679 | VH3-23__IGHD4-11*01 (1) >3__IGHJ6*01 | 2677 | V2-15__IGLJ7*01 | 851 | 1456 |
| 2680 | VH3-23__IGHD4-17*01>2__IGHJ6*01 | 2678 | V2-15__IGLJ7*01 | 851 | 1456 |
| 2681 | VH3-23__IGHD4-17*01>3__IGHJ6*01 | 2679 | V2-15__IGLJ7*01 | 851 | 1456 |
| 2682 | VH3-23__IGHD4-23*01>2__IGHJ6*01 | 2680 | V2-15__IGLJ7*01 | 851 | 1456 |
| 2683 | VH3-23__IGHD4-23*01>3__IGHJ6*01 | 2681 | V2-15__IGLJ7*01 | 851 | 1456 |
| 2684 | VH3-23__IGHD5-5*01 (2) >1__IGHJ6*01 | 2682 | V2-15__IGLJ7*01 | 851 | 1456 |
| 2685 | VH3-23__IGHD5-5*01 (2) >2__IGHJ6*01 | 2683 | V2-15__IGLJ7*01 | 851 | 1456 |
| 2686 | VH3-23__IGHD5-5*01 (2) >3__IGHJ6*01 | 2684 | V2-15__IGLJ7*01 | 851 | 1456 |
| 2687 | VH3-23__IGHD5-12*01>1__IGHJ6*01 | 2685 | V2-15__IGLJ7*01 | 851 | 1456 |
| 2688 | VH3-23__IGHD5-12*01>3__IGHJ6*01 | 2686 | V2-15__IGLJ7*01 | 851 | 1456 |
| 2689 | VH3-23__IGHD5-18*01 (2) >1__IGHJ6*01 | 2687 | V2-15__IGLJ7*01 | 851 | 1456 |
| 2690 | VH3-23__IGHD5-18*01 (2) >2__IGHJ6*01 | 2688 | V2-15__IGLJ7*01 | 851 | 1456 |
| 2691 | VH3-23__IGHD5-18*01 (2) >3__IGHJ6*01 | 2689 | V2-15__IGLJ7*01 | 851 | 1456 |
| 2692 | VH3-23__IGHD5-24*01>1__IGHJ6*01 | 2690 | V2-15__IGLJ7*01 | 851 | 1456 |
| 2693 | VH3-23__IGHD5-24*01>3__IGHJ6*01 | 2691 | V2-15__IGLJ7*01 | 851 | 1456 |
| 2694 | VH3-23__IGHD6-6*01>1__IGHJ6*01 | 2692 | V2-15__IGLJ7*01 | 851 | 1456 |
| 2695 | VH3-23__IGHD1-1*01>1'__IGHJ6*01 | 2702 | V2-15__IGLJ7*01 | 851 | 1456 |
| 2696 | VH3-23__IGHD1-1*01>2'__IGHJ6*01 | 2703 | V2-15__IGLJ7*01 | 851 | 1456 |
| 2697 | VH3-23__IGHD1-1*01>3'__IGHJ6*01 | 2704 | V2-15__IGLJ7*01 | 851 | 1456 |
| 2698 | VH3-23__IGHD1-7*01>1'__IGHJ6*01 | 2705 | V2-15__IGLJ7*01 | 851 | 1456 |
| 2699 | VH3-23__IGHD1-7*01>3'__IGHJ6*01 | 2706 | V2-15__IGLJ7*01 | 851 | 1456 |
| 2700 | VH3-23__IGHD1-14*01>1'__IGHJ6*01 | 2707 | V2-15__IGLJ7*01 | 851 | 1456 |
| 2701 | VH3-23__IGHD1-14*01>2'__IGHJ6*01 | 2708 | V2-15__IGLJ7*01 | 851 | 1456 |
| 2702 | VH3-23__IGHD1-14*01>3'__IGHJ6*01 | 2709 | V2-15__IGLJ7*01 | 851 | 1456 |
| 2703 | VH3-23__IGHD1-20*01>1'__IGHJ6*01 | 2710 | V2-15__IGLJ7*01 | 851 | 1456 |
| 2704 | VH3-23__IGHD1-20*01>2'__IGHJ6*01 | 2711 | V2-15__IGLJ7*01 | 851 | 1456 |
| 2705 | VH3-23__IGHD1-20*01>3'__IGHJ6*01 | 2712 | V2-15__IGLJ7*01 | 851 | 1456 |
| 2706 | VH3-23__IGHD1-26*01>1'__IGHJ6*01 | 2713 | V2-15__IGLJ7*01 | 851 | 1456 |
| 2707 | VH3-23__IGHD1-26*01>1__IGHJ6*01_B | 2714 | V2-15__IGLJ7*01 | 851 | 1456 |
| 2708 | VH3-23__IGHD2-2*01>2__IGHJ6*01_B | 2715 | V2-15__IGLJ7*01 | 851 | 1456 |
| 2709 | VH3-23__IGHD2-2*01>3'__IGHJ6*01 | 2716 | V2-15__IGLJ7*01 | 851 | 1456 |
| 2710 | VH3-23__IGHD2-8*01>1'__IGHJ6*01 | 2717 | V2-15__IGLJ7*01 | 851 | 1456 |
| 2711 | VH3-23__IGHD2-15*01>1'__IGHJ6*01 | 2718 | V2-15__IGLJ7*01 | 851 | 1456 |
| 2712 | VH3-23__IGHD2-15*01>3'__IGHJ6*01 | 2719 | V2-15__IGLJ7*01 | 851 | 1456 |
| 2713 | VH3-23__IGHD2-21*01>1'__IGHJ6*01 | 2720 | V2-15__IGLJ7*01 | 851 | 1456 |
| 2714 | VH3-23__IGHD2-21*01>3'__IGHJ6*01 | 2721 | V2-15__IGLJ7*01 | 851 | 1456 |
| 2715 | VH3-23__IGHD3-3*01>1'__IGHJ6*01 | 2722 | V2-15__IGLJ7*01 | 851 | 1456 |
| 2716 | VH3-23__IGHD3-3*01>3'__IGHJ6*01 | 2723 | V2-15__IGLJ7*01 | 851 | 1456 |
| 2717 | VH3-23__IGHD3-9*01>1'__IGHJ6*01 | 2724 | V2-15__IGLJ7*01 | 851 | 1456 |
| 2718 | VH3-23__IGHD3-9*01>3'__IGHJ6*01 | 2725 | V2-15__IGLJ7*01 | 851 | 1456 |
| 2719 | VH3-23__IGHD3-10*01>1'__IGHJ6*01 | 2726 | V2-15__IGLJ7*01 | 851 | 1456 |
| 2720 | VH3-23__IGHD3-10*01>3'__IGHJ6*01 | 2727 | V2-15__IGLJ7*01 | 851 | 1456 |
| 2721 | VH3-23__IGHD3-16*01>1'__IGHJ6*01 | 2728 | V2-15__IGLJ7*01 | 851 | 1456 |
| 2722 | VH3-23__IGHD3-16*01>3'__IGHJ6*01 | 2729 | V2-15__IGLJ7*01 | 851 | 1456 |
| 2723 | VH3-23__IGHD3-22*01>1'__IGHJ6*01 | 2730 | V2-15__IGLJ7*01 | 851 | 1456 |
| 2724 | VH3-23__IGHD4-4*01 (1) >1'__IGHJ6*01 | 2731 | V2-15__IGLJ7*01 | 851 | 1456 |
| 2725 | VH3-23__IGHD4-4*01 (1) >3'__IGHJ6*01 | 2732 | V2-15__IGLJ7*01 | 851 | 1456 |
| 2726 | VH3-23__IGHD4-11*01 (1) >1'__IGHJ6*01 | 2733 | V2-15__IGLJ7*01 | 851 | 1456 |
| 2727 | VH3-23__IGHD4-11*01 (1) >3'__IGHJ6*01 | 2734 | V2-15__IGLJ7*01 | 851 | 1456 |
| 2728 | VH3-23__IGHD4-17*01>1'__IGHJ6*01 | 2735 | V2-15__IGLJ7*01 | 851 | 1456 |
| 2729 | VH3-23__IGHD4-17*01>3'__IGHJ6*01 | 2736 | V2-15__IGLJ7*01 | 851 | 1456 |
| 2730 | VH3-23__IGHD4-23*01>1'__IGHJ6*01 | 2737 | V2-15__IGLJ7*01 | 851 | 1456 |
| 2731 | VH3-23__IGHD4-23*01>3'__IGHJ6*01 | 2738 | V2-15__IGLJ7*01 | 851 | 1456 |
| 2732 | VH3-23__IGHD5-5*01 (2) >1'__IGHJ6*01 | 2739 | V2-15__IGLJ7*01 | 851 | 1456 |
| 2733 | VH3-23__IGHD5-5*01 (2) >3'__IGHJ6*01 | 2740 | V2-15__IGLJ7*01 | 851 | 1456 |
| 2734 | VH3-23__IGHD5-12*01>1'__IGHJ6*01 | 2741 | V2-15__IGLJ7*01 | 851 | 1456 |
| 2735 | VH3-23__IGHD5-12*01>3'__IGHJ6*01 | 2742 | V2-15__IGLJ7*01 | 851 | 1456 |
| 2736 | VH3-23__IGHD5-18*01 (2) >1'__IGHJ6*01 | 2743 | V2-15__IGLJ7*01 | 851 | 1456 |
| 2737 | VH3-23__IGHD5-18*01 (2) >3'__IGHJ6*01 | 2744 | V2-15__IGLJ7*01 | 851 | 1456 |
| 2738 | VH3-23__IGHD5-24*01>1'__IGHJ6*01 | 2745 | V2-15__IGLJ7*01 | 851 | 1456 |
| 2739 | VH3-23__IGHD5-24*01>3'__IGHJ6*01 | 2746 | V2-15__IGLJ7*01 | 851 | 1456 |
| 2740 | VH3-23__IGHD6-6*01>1'__IGHJ6*01 | 2747 | V2-15__IGLJ7*01 | 851 | 1456 |
| 2741 | VH3-23__IGHD6-6*01>2'__IGHJ6*01 | 2748 | V2-15__IGLJ7*01 | 851 | 1456 |
| 2742 | VH3-23__IGHD6-6*01>3'__IGHJ6*01 | 2749 | V2-15__IGLJ7*01 | 851 | 1456 |
| 2743 | VH3-23__IGHD1-1*01>1__IGHJ6*01 | 2645 | V2-17__IGLJ2*01 | 852 | 1457 |
| 2744 | VH3-23__IGHD1-1*01>2__IGHJ6*01 | 2646 | V2-17__IGLJ2*01 | 852 | 1457 |
| 2745 | VH3-23__IGHD1-1*01>3__IGHJ6*01 | 2647 | V2-17__IGLJ2*01 | 852 | 1457 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 2746 | VH3-23_IGHD1-7*01>1_IGHJ6*01 | 2648 | V2-17_IGLJ2*01 | 852 | 1457 |
| 2747 | VH3-23_IGHD1-7*01>3_IGHJ6*01 | 2649 | V2-17_IGLJ2*01 | 852 | 1457 |
| 2748 | VH3-23_IGHD1-14*01>1_IGHJ6*01 | 2650 | V2-17_IGLJ2*01 | 852 | 1457 |
| 2749 | VH3-23_IGHD1-14*01>3_IGHJ6*01 | 2651 | V2-17_IGLJ2*01 | 852 | 1457 |
| 2750 | VH3-23_IGHD1-20*01>1_IGHJ6*01 | 2652 | V2-17_IGLJ2*01 | 852 | 1457 |
| 2751 | VH3-23_IGHD1-20*01>3_IGHJ6*01 | 2653 | V2-17_IGLJ2*01 | 852 | 1457 |
| 2752 | VH3-23_IGHD1-26*01>1_IGHJ6*01 | 2654 | V2-17_IGLJ2*01 | 852 | 1457 |
| 2753 | VH3-23_IGHD1-26*01>3_IGHJ6*01 | 2655 | V2-17_IGLJ2*01 | 852 | 1457 |
| 2754 | VH3-23_IGHD2-2*01>2_IGHJ6*01 | 2656 | V2-17_IGLJ2*01 | 852 | 1457 |
| 2755 | VH3-23_IGHD2-2*01>3_IGHJ6*01 | 2657 | V2-17_IGLJ2*01 | 852 | 1457 |
| 2756 | VH3-23_IGHD2-8*01>2_IGHJ6*01 | 2658 | V2-17_IGLJ2*01 | 852 | 1457 |
| 2757 | VH3-23_IGHD2-8*01>3_IGHJ6*01 | 2659 | V2-17_IGLJ2*01 | 852 | 1457 |
| 2758 | VH3-23_IGHD2-15*01>2_IGHJ6*01 | 2660 | V2-17_IGLJ2*01 | 852 | 1457 |
| 2759 | VH3-23_IGHD2-15*01>3_IGHJ6*01 | 2661 | V2-17_IGLJ2*01 | 852 | 1457 |
| 2760 | VH3-23_IGHD2-21*01>2_IGHJ6*01 | 2662 | V2-17_IGLJ2*01 | 852 | 1457 |
| 2761 | VH3-23_IGHD2-21*01>3_IGHJ6*01 | 2663 | V2-17_IGLJ2*01 | 852 | 1457 |
| 2762 | VH3-23_IGHD3-3*01>1_IGHJ6*01 | 2664 | V2-17_IGLJ2*01 | 852 | 1457 |
| 2763 | VH3-23_IGHD3-3*01>2_IGHJ6*01 | 2665 | V2-17_IGLJ2*01 | 852 | 1457 |
| 2764 | VH3-23_IGHD3-3*01>3_IGHJ6*01 | 2666 | V2-17_IGLJ2*01 | 852 | 1457 |
| 2765 | VH3-23_IGHD3-9*01>2_IGHJ6*01 | 2667 | V2-17_IGLJ2*01 | 852 | 1457 |
| 2766 | VH3-23_IGHD3-10*01>2_IGHJ6*01 | 2668 | V2-17_IGLJ2*01 | 852 | 1457 |
| 2767 | VH3-23_IGHD3-10*01>3_IGHJ6*01 | 2669 | V2-17_IGLJ2*01 | 852 | 1457 |
| 2768 | VH3-23_IGHD3-16*01>2_IGHJ6*01 | 2670 | V2-17_IGLJ2*01 | 852 | 1457 |
| 2769 | VH3-23_IGHD3-16*01>3_IGHJ6*01 | 2671 | V2-17_IGLJ2*01 | 852 | 1457 |
| 2770 | VH3-23_IGHD3-22*01>2_IGHJ6*01 | 2672 | V2-17_IGLJ2*01 | 852 | 1457 |
| 2771 | VH3-23_IGHD3-22*01>3_IGHJ6*01 | 2673 | V2-17_IGLJ2*01 | 852 | 1457 |
| 2772 | VH3-23_IGHD4-4*01 (1) >2_IGHJ6*01 | 2674 | V2-17_IGLJ2*01 | 852 | 1457 |
| 2773 | VH3-23_IGHD4-4*01 (1) >3_IGHJ6*01 | 2675 | V2-17_IGLJ2*01 | 852 | 1457 |
| 2774 | VH3-23_IGHD4-11*01 (1) >2_IGHJ6*01 | 2676 | V2-17_IGLJ2*01 | 852 | 1457 |
| 2775 | VH3-23_IGHD4-11*01 (1) >3_IGHJ6*01 | 2677 | V2-17_IGLJ2*01 | 852 | 1457 |
| 2776 | VH3-23_IGHD4-17*01>2_IGHJ6*01 | 2678 | V2-17_IGLJ2*01 | 852 | 1457 |
| 2777 | VH3-23_IGHD4-17*01>3_IGHJ6*01 | 2679 | V2-17_IGLJ2*01 | 852 | 1457 |
| 2778 | VH3-23_IGHD4-23*01>2_IGHJ6*01 | 2680 | V2-17_IGLJ2*01 | 852 | 1457 |
| 2779 | VH3-23_IGHD4-23*01>3_IGHJ6*01 | 2681 | V2-17_IGLJ2*01 | 852 | 1457 |
| 2780 | VH3-23_IGHD5-5*01 (2) >1_IGHJ6*01 | 2682 | V2-17_IGLJ2*01 | 852 | 1457 |
| 2781 | VH3-23_IGHD5-5*01 (2) >2_IGHJ6*01 | 2683 | V2-17_IGLJ2*01 | 852 | 1457 |
| 2782 | VH3-23_IGHD5-5*01 (2) >3_IGHJ6*01 | 2684 | V2-17_IGLJ2*01 | 852 | 1457 |
| 2783 | VH3-23_IGHD5-12*01>1_IGHJ6*01 | 2685 | V2-17_IGLJ2*01 | 852 | 1457 |
| 2784 | VH3-23_IGHD5-12*01>3_IGHJ6*01 | 2686 | V2-17_IGLJ2*01 | 852 | 1457 |
| 2785 | VH3-23_IGHD5-18*01 (2) >1_IGHJ6*01 | 2687 | V2-17_IGLJ2*01 | 852 | 1457 |
| 2786 | VH3-23_IGHD5-18*01 (2) >2_IGHJ6*01 | 2688 | V2-17_IGLJ2*01 | 852 | 1457 |
| 2787 | VH3-23_IGHD5-18*01 (2) >3_IGHJ6*01 | 2689 | V2-17_IGLJ2*01 | 852 | 1457 |
| 2788 | VH3-23_IGHD5-24*01>1_IGHJ6*01 | 2690 | V2-17_IGLJ2*01 | 852 | 1457 |
| 2789 | VH3-23_IGHD5-24*01>3_IGHJ6*01 | 2691 | V2-17_IGLJ2*01 | 852 | 1457 |
| 2790 | VH3-23_IGHD6-6*01>1_IGHJ6*01 | 2692 | V2-17_IGLJ2*01 | 852 | 1457 |
| 2791 | VH3-23_IGHD1-1*01>1'_IGHJ6*01 | 2702 | V2-17_IGLJ2*01 | 852 | 1457 |
| 2792 | VH3-23_IGHD1-1*01>2'_IGHJ6*01 | 2703 | V2-17_IGLJ2*01 | 852 | 1457 |
| 2793 | VH3-23_IGHD1-1*01>3'_IGHJ6*01 | 2704 | V2-17_IGLJ2*01 | 852 | 1457 |
| 2794 | VH3-23_IGHD1-7*01>1'_IGHJ6*01 | 2705 | V2-17_IGLJ2*01 | 852 | 1457 |
| 2795 | VH3-23_IGHD1-7*01>3'_IGHJ6*01 | 2706 | V2-17_IGLJ2*01 | 852 | 1457 |
| 2796 | VH3-23_IGHD1-14*01>1'_IGHJ6*01 | 2707 | V2-17_IGLJ2*01 | 852 | 1457 |
| 2797 | VH3-23_IGHD1-14*01>2'_IGHJ6*01 | 2708 | V2-17_IGLJ2*01 | 852 | 1457 |
| 2798 | VH3-23_IGHD1-14*01>3'_IGHJ6*01 | 2709 | V2-17_IGLJ2*01 | 852 | 1457 |
| 2799 | VH3-23_IGHD1-20*01>1'_IGHJ6*01 | 2710 | V2-17_IGLJ2*01 | 852 | 1457 |
| 2800 | VH3-23_IGHD1-20*01>2'_IGHJ6*01 | 2711 | V2-17_IGLJ2*01 | 852 | 1457 |
| 2801 | VH3-23_IGHD1-20*01>3'_IGHJ6*01 | 2712 | V2-17_IGLJ2*01 | 852 | 1457 |
| 2802 | VH3-23_IGHD1-26*01>1'_IGHJ6*01 | 2713 | V2-17_IGLJ2*01 | 852 | 1457 |
| 2803 | VH3-23_IGHD1-26*01>1_IGHJ6*01_B | 2714 | V2-17_IGLJ2*01 | 852 | 1457 |
| 2804 | VH3-23_IGHD2-2*01>2_IGHJ6*01_B | 2715 | V2-17_IGLJ2*01 | 852 | 1457 |
| 2805 | VH3-23_IGHD2-2*01>3'_IGHJ6*01 | 2716 | V2-17_IGLJ2*01 | 852 | 1457 |
| 2806 | VH3-23_IGHD2-8*01>1'_IGHJ6*01 | 2717 | V2-17_IGLJ2*01 | 852 | 1457 |
| 2807 | VH3-23_IGHD2-15*01>1'_IGHJ6*01 | 2718 | V2-17_IGLJ2*01 | 852 | 1457 |
| 2808 | VH3-23_IGHD2-15*01>3'_IGHJ6*01 | 2719 | V2-17_IGLJ2*01 | 852 | 1457 |
| 2809 | VH3-23_IGHD2-21*01>1'_IGHJ6*01 | 2720 | V2-17_IGLJ2*01 | 852 | 1457 |
| 2810 | VH3-23_IGHD2-21*01>3'_IGHJ6*01 | 2721 | V2-17_IGLJ2*01 | 852 | 1457 |
| 2811 | VH3-23_IGHD3-3*01>1'_IGHJ6*01 | 2722 | V2-17_IGLJ2*01 | 852 | 1457 |
| 2812 | VH3-23_IGHD3-3*01>3'_IGHJ6*01 | 2723 | V2-17_IGLJ2*01 | 852 | 1457 |
| 2813 | VH3-23_IGHD3-9*01>1'_IGHJ6*01 | 2724 | V2-17_IGLJ2*01 | 852 | 1457 |
| 2814 | VH3-23_IGHD3-9*01>3'_IGHJ6*01 | 2725 | V2-17_IGLJ2*01 | 852 | 1457 |
| 2815 | VH3-23_IGHD3-10*01>1'_IGHJ6*01 | 2726 | V2-17_IGLJ2*01 | 852 | 1457 |
| 2816 | VH3-23_IGHD3-10*01>3'_IGHJ6*01 | 2727 | V2-17_IGLJ2*01 | 852 | 1457 |
| 2817 | VH3-23_IGHD3-16*01>1'_IGHJ6*01 | 2728 | V2-17_IGLJ2*01 | 852 | 1457 |
| 2818 | VH3-23_IGHD3-16*01>3'_IGHJ6*01 | 2729 | V2-17_IGLJ2*01 | 852 | 1457 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 2819 | VH3-23__IGHD3-22*01>1'__IGHJ6*01 | 2730 | V2-17__IGLJ2*01 | 852 | 1457 |
| 2820 | VH3-23__IGHD4-4*01 (1) >1'__IGHJ6*01 | 2731 | V2-17__IGLJ2*01 | 852 | 1457 |
| 2821 | VH3-23__IGHD4-4*01 (1) >3'__IGHJ6*01 | 2732 | V2-17__IGLJ2*01 | 852 | 1457 |
| 2822 | VH3-23__IGHD4-11*01 (1) >1'__IGHJ6*01 | 2733 | V2-17__IGLJ2*01 | 852 | 1457 |
| 2823 | VH3-23__IGHD4-11*01 (1) >3'__IGHJ6*01 | 2734 | V2-17__IGLJ2*01 | 852 | 1457 |
| 2824 | VH3-23__IGHD4-17*01>1'__IGHJ6*01 | 2735 | V2-17__IGLJ2*01 | 852 | 1457 |
| 2825 | VH3-23__IGHD4-17*01>3'__IGHJ6*01 | 2736 | V2-17__IGLJ2*01 | 852 | 1457 |
| 2826 | VH3-23__IGHD4-23*01>1'__IGHJ6*01 | 2737 | V2-17__IGLJ2*01 | 852 | 1457 |
| 2827 | VH3-23__IGHD4-23*01>3'__IGHJ6*01 | 2738 | V2-17__IGLJ2*01 | 852 | 1457 |
| 2828 | VH3-23__IGHD5-5*01 (2) >1'__IGHJ6*01 | 2739 | V2-17__IGLJ2*01 | 852 | 1457 |
| 2829 | VH3-23__IGHD5-5*01 (2) >3'__IGHJ6*01 | 2740 | V2-17__IGLJ2*01 | 852 | 1457 |
| 2830 | VH3-23__IGHD5-12*01>1'__IGHJ6*01 | 2741 | V2-17__IGLJ2*01 | 852 | 1457 |
| 2831 | VH3-23__IGHD5-12*01>3'__IGHJ6*01 | 2742 | V2-17__IGLJ2*01 | 852 | 1457 |
| 2832 | VH3-23__IGHD5-18*01 (2) >1'__IGHJ6*01 | 2743 | V2-17__IGLJ2*01 | 852 | 1457 |
| 2833 | VH3-23__IGHD5-18*01 (2) >3'__IGHJ6*01 | 2744 | V2-17__IGLJ2*01 | 852 | 1457 |
| 2834 | VH3-23__IGHD5-24*01>1'__IGHJ6*01 | 2745 | V2-17__IGLJ2*01 | 852 | 1457 |
| 2835 | VH3-23__IGHD5-24*01>3'__IGHJ6*01 | 2746 | V2-17__IGLJ2*01 | 852 | 1457 |
| 2836 | VH3-23__IGHD6-6*01>1'__IGHJ6*01 | 2747 | V2-17__IGLJ2*01 | 852 | 1457 |
| 2837 | VH3-23__IGHD6-6*01>2'__IGHJ6*01 | 2748 | V2-17__IGLJ2*01 | 852 | 1457 |
| 2838 | VH3-23__IGHD6-6*01>3'__IGHJ6*01 | 2749 | V2-17__IGLJ2*01 | 852 | 1457 |
| 2839 | VH3-23__IGHD1-1*01>1__IGHJ6*01 | 2645 | V2-6__IGLJ4*01 | 854 | 1459 |
| 2840 | VH3-23__IGHD1-1*01>2__IGHJ6*01 | 2646 | V2-6__IGLJ4*01 | 854 | 1459 |
| 2841 | VH3-23__IGHD1-1*01>3__IGHJ6*01 | 2647 | V2-6__IGLJ4*01 | 854 | 1459 |
| 2842 | VH3-23__IGHD1-7*01>1__IGHJ6*01 | 2648 | V2-6__IGLJ4*01 | 854 | 1459 |
| 2843 | VH3-23__IGHD1-7*01>3__IGHJ6*01 | 2649 | V2-6__IGLJ4*01 | 854 | 1459 |
| 2844 | VH3-23__IGHD1-14*01>1__IGHJ6*01 | 2650 | V2-6__IGLJ4*01 | 854 | 1459 |
| 2845 | VH3-23__IGHD1-14*01>3__IGHJ6*01 | 2651 | V2-6__IGLJ4*01 | 854 | 1459 |
| 2846 | VH3-23__IGHD1-20*01>1__IGHJ6*01 | 2652 | V2-6__IGLJ4*01 | 854 | 1459 |
| 2847 | VH3-23__IGHD1-20*01>3__IGHJ6*01 | 2653 | V2-6__IGLJ4*01 | 854 | 1459 |
| 2848 | VH3-23__IGHD1-26*01>1__IGHJ6*01 | 2654 | V2-6__IGLJ4*01 | 854 | 1459 |
| 2849 | VH3-23__IGHD1-26*01>3__IGHJ6*01 | 2655 | V2-6__IGLJ4*01 | 854 | 1459 |
| 2850 | VH3-23__IGHD2-2*01>2__IGHJ6*01 | 2656 | V2-6__IGLJ4*01 | 854 | 1459 |
| 2851 | VH3-23__IGHD2-2*01>3__IGHJ6*01 | 2657 | V2-6__IGLJ4*01 | 854 | 1459 |
| 2852 | VH3-23__IGHD2-8*01>2__IGHJ6*01 | 2658 | V2-6__IGLJ4*01 | 854 | 1459 |
| 2853 | VH3-23__IGHD2-8*01>3__IGHJ6*01 | 2659 | V2-6__IGLJ4*01 | 854 | 1459 |
| 2854 | VH3-23__IGHD2-15*01>2__IGHJ6*01 | 2660 | V2-6__IGLJ4*01 | 854 | 1459 |
| 2855 | VH3-23__IGHD2-15*01>3__IGHJ6*01 | 2661 | V2-6__IGLJ4*01 | 854 | 1459 |
| 2856 | VH3-23__IGHD2-21*01>2__IGHJ6*01 | 2662 | V2-6__IGLJ4*01 | 854 | 1459 |
| 2857 | VH3-23__IGHD2-21*01>3__IGHJ6*01 | 2663 | V2-6__IGLJ4*01 | 854 | 1459 |
| 2858 | VH3-23__IGHD3-3*01>1__IGHJ6*01 | 2664 | V2-6__IGLJ4*01 | 854 | 1459 |
| 2859 | VH3-23__IGHD3-3*01>2__IGHJ6*01 | 2665 | V2-6__IGLJ4*01 | 854 | 1459 |
| 2860 | VH3-23__IGHD3-3*01>3__IGHJ6*01 | 2666 | V2-6__IGLJ4*01 | 854 | 1459 |
| 2861 | VH3-23__IGHD3-9*01>2__IGHJ6*01 | 2667 | V2-6__IGLJ4*01 | 854 | 1459 |
| 2862 | VH3-23__IGHD3-10*01>2__IGHJ6*01 | 2668 | V2-6__IGLJ4*01 | 854 | 1459 |
| 2863 | VH3-23__IGHD3-10*01>3__IGHJ6*01 | 2669 | V2-6__IGLJ4*01 | 854 | 1459 |
| 2864 | VH3-23__IGHD3-16*01>2__IGHJ6*01 | 2670 | V2-6__IGLJ4*01 | 854 | 1459 |
| 2865 | VH3-23__IGHD3-16*01>3__IGHJ6*01 | 2671 | V2-6__IGLJ4*01 | 854 | 1459 |
| 2866 | VH3-23__IGHD3-22*01>2__IGHJ6*01 | 2672 | V2-6__IGLJ4*01 | 854 | 1459 |
| 2867 | VH3-23__IGHD3-22*01>3__IGHJ6*01 | 2673 | V2-6__IGLJ4*01 | 854 | 1459 |
| 2868 | VH3-23__IGHD4-4*01 (1) >2__IGHJ6*01 | 2674 | V2-6__IGLJ4*01 | 854 | 1459 |
| 2869 | VH3-23__IGHD4-4*01 (1) >3__IGHJ6*01 | 2675 | V2-6__IGLJ4*01 | 854 | 1459 |
| 2870 | VH3-23__IGHD4-11*01 (1) >2__IGHJ6*01 | 2676 | V2-6__IGLJ4*01 | 854 | 1459 |
| 2871 | VH3-23__IGHD4-11*01 (1) >3__IGHJ6*01 | 2677 | V2-6__IGLJ4*01 | 854 | 1459 |
| 2872 | VH3-23__IGHD4-17*01>2__IGHJ6*01 | 2678 | V2-6__IGLJ4*01 | 854 | 1459 |
| 2873 | VH3-23__IGHD4-17*01>3__IGHJ6*01 | 2679 | V2-6__IGLJ4*01 | 854 | 1459 |
| 2874 | VH3-23__IGHD4-23*01>2__IGHJ6*01 | 2680 | V2-6__IGLJ4*01 | 854 | 1459 |
| 2875 | VH3-23__IGHD4-23*01>3__IGHJ6*01 | 2681 | V2-6__IGLJ4*01 | 854 | 1459 |
| 2876 | VH3-23__IGHD5-5*01 (2) >1__IGHJ6*01 | 2682 | V2-6__IGLJ4*01 | 854 | 1459 |
| 2877 | VH3-23__IGHD5-5*01 (2) >2__IGHJ6*01 | 2683 | V2-6__IGLJ4*01 | 854 | 1459 |
| 2878 | VH3-23__IGHD5-5*01 (2) >3__IGHJ6*01 | 2684 | V2-6__IGLJ4*01 | 854 | 1459 |
| 2879 | VH3-23__IGHD5-12*01>1__IGHJ6*01 | 2685 | V2-6__IGLJ4*01 | 854 | 1459 |
| 2880 | VH3-23__IGHD5-12*01>3__IGHJ6*01 | 2686 | V2-6__IGLJ4*01 | 854 | 1459 |
| 2881 | VH3-23__IGHD5-18*01 (2) >1__IGHJ6*01 | 2687 | V2-6__IGLJ4*01 | 854 | 1459 |
| 2882 | VH3-23__IGHD5-18*01 (2) >2__IGHJ6*01 | 2688 | V2-6__IGLJ4*01 | 854 | 1459 |
| 2883 | VH3-23__IGHD5-18*01 (2) >3__IGHJ6*01 | 2689 | V2-6__IGLJ4*01 | 854 | 1459 |
| 2884 | VH3-23__IGHD5-24*01>1__IGHJ6*01 | 2690 | V2-6__IGLJ4*01 | 854 | 1459 |
| 2885 | VH3-23__IGHD5-24*01>3__IGHJ6*01 | 2691 | V2-6__IGLJ4*01 | 854 | 1459 |
| 2886 | VH3-23__IGHD6-6*01>1__IGHJ6*01 | 2692 | V2-6__IGLJ4*01 | 854 | 1459 |
| 2887 | VH3-23__IGHD1-1*01>1'__IGHJ6*01 | 2702 | V2-6__IGLJ4*01 | 854 | 1459 |
| 2888 | VH3-23__IGHD1-1*01>2'__IGHJ6*01 | 2703 | V2-6__IGLJ4*01 | 854 | 1459 |
| 2889 | VH3-23__IGHD1-1*01>3'__IGHJ6*01 | 2704 | V2-6__IGLJ4*01 | 854 | 1459 |
| 2890 | VH3-23__IGHD1-7*01>1'__IGHJ6*01 | 2705 | V2-6__IGLJ4*01 | 854 | 1459 |
| 2891 | VH3-23__IGHD1-7*01>3'__IGHJ6*01 | 2706 | V2-6__IGLJ4*01 | 854 | 1459 |

TABLE 17A-continued

Exemplary Nucleic Acid Paired Library

| | HEAVY CHAIN Name | RS SEQ ID NO | LIGHT CHAIN Name | RS SEQ ID NO | NO RS SEQ ID NO |
|---|---|---|---|---|---|
| 2892 | VH3-23_IGHD1-14*01>1'_IGHJ6*01 | 2707 | V2-6_IGLJ4*01 | 854 | 1459 |
| 2893 | VH3-23_IGHD1-14*01>2'_IGHJ6*01 | 2708 | V2-6_IGLJ4*01 | 854 | 1459 |
| 2894 | VH3-23_IGHD1-14*01>3'_IGHJ6*01 | 2709 | V2-6_IGLJ4*01 | 854 | 1459 |
| 2895 | VH3-23_IGHD1-20*01>1'_IGHJ6*01 | 2710 | V2-6_IGLJ4*01 | 854 | 1459 |
| 2896 | VH3-23_IGHD1-20*01>2'_IGHJ6*01 | 2711 | V2-6_IGLJ4*01 | 854 | 1459 |
| 2897 | VH3-23_IGHD1-20*01>3'_IGHJ6*01 | 2712 | V2-6_IGLJ4*01 | 854 | 1459 |
| 2898 | VH3-23_IGHD1-26*01>1'_IGHJ6*01 | 2713 | V2-6_IGLJ4*01 | 854 | 1459 |
| 2899 | VH3-23_IGHD1-26*01>1_IGHJ6*01_B | 2714 | V2-6_IGLJ4*01 | 854 | 1459 |
| 2900 | VH3-23_IGHD2-2*01>2_IGHJ6*01_B | 2715 | V2-6_IGLJ4*01 | 854 | 1459 |
| 2901 | VH3-23_IGHD2-2*01>3'_IGHJ6*01 | 2716 | V2-6_IGLJ4*01 | 854 | 1459 |
| 2902 | VH3-23_IGHD2-8*01>1'_IGHJ6*01 | 2717 | V2-6_IGLJ4*01 | 854 | 1459 |
| 2903 | VH3-23_IGHD2-15*01>1'_IGHJ6*01 | 2718 | V2-6_IGLJ4*01 | 854 | 1459 |
| 2904 | VH3-23_IGHD2-15*01>3'_IGHJ6*01 | 2719 | V2-6_IGLJ4*01 | 854 | 1459 |
| 2905 | VH3-23_IGHD2-21*01>1'_IGHJ6*01 | 2720 | V2-6_IGLJ4*01 | 854 | 1459 |
| 2906 | VH3-23_IGHD2-21*01>3'_IGHJ6*01 | 2721 | V2-6_IGLJ4*01 | 854 | 1459 |
| 2907 | VH3-23_IGHD3-3*01>1'_IGHJ6*01 | 2722 | V2-6_IGLJ4*01 | 854 | 1459 |
| 2908 | VH3-23_IGHD3-3*01>3'_IGHJ6*01 | 2723 | V2-6_IGLJ4*01 | 854 | 1459 |
| 2909 | VH3-23_IGHD3-9*01>1'_IGHJ6*01 | 2724 | V2-6_IGLJ4*01 | 854 | 1459 |
| 2910 | VH3-23_IGHD3-9*01>3'_IGHJ6*01 | 2725 | V2-6_IGLJ4*01 | 854 | 1459 |
| 2911 | VH3-23_IGHD3-10*01>1'_IGHJ6*01 | 2726 | V2-6_IGLJ4*01 | 854 | 1459 |
| 2912 | VH3-23_IGHD3-10*01>3'_IGHJ6*01 | 2727 | V2-6_IGLJ4*01 | 854 | 1459 |
| 2913 | VH3-23_IGHD3-16*01>1'_IGHJ6*01 | 2728 | V2-6_IGLJ4*01 | 854 | 1459 |
| 2914 | VH3-23_IGHD3-16*01>3'_IGHJ6*01 | 2729 | V2-6_IGLJ4*01 | 854 | 1459 |
| 2915 | VH3-23_IGHD3-22*01>1'_IGHJ6*01 | 2730 | V2-6_IGLJ4*01 | 854 | 1459 |
| 2916 | VH3-23_IGHD4-4*01 (1) >1'_IGHJ6*01 | 2731 | V2-6_IGLJ4*01 | 854 | 1459 |
| 2917 | VH3-23_IGHD4-4*01 (1) >3'_IGHJ6*01 | 2732 | V2-6_IGLJ4*01 | 854 | 1459 |
| 2918 | VH3-23_IGHD4-11*01 (1) >1'_IGHJ6*01 | 2733 | V2-6_IGLJ4*01 | 854 | 1459 |
| 2919 | VH3-23_IGHD4-11*01 (1) >3'_IGHJ6*01 | 2734 | V2-6_IGLJ4*01 | 854 | 1459 |
| 2920 | VH3-23_IGHD4-17*01>1'_IGHJ6*01 | 2735 | V2-6_IGLJ4*01 | 854 | 1459 |
| 2921 | VH3-23_IGHD4-17*01>3'_IGHJ6*01 | 2736 | V2-6_IGLJ4*01 | 854 | 1459 |
| 2922 | VH3-23_IGHD4-23*01>1'_IGHJ6*01 | 2737 | V2-6_IGLJ4*01 | 854 | 1459 |
| 2923 | VH3-23_IGHD4-23*01>3'_IGHJ6*01 | 2738 | V2-6_IGLJ4*01 | 854 | 1459 |
| 2924 | VH3-23_IGHD5-5*01 (2) >1'_IGHJ6*01 | 2739 | V2-6_IGLJ4*01 | 854 | 1459 |
| 2925 | VH3-23_IGHD5-5*01 (2) >3'_IGHJ6*01 | 2740 | V2-6_IGLJ4*01 | 854 | 1459 |
| 2926 | VH3-23_IGHD5-12*01>1'_IGHJ6*01 | 2741 | V2-6_IGLJ4*01 | 854 | 1459 |
| 2927 | VH3-23_IGHD5-12*01>3'_IGHJ6*01 | 2742 | V2-6_IGLJ4*01 | 854 | 1459 |
| 2928 | VH3-23_IGHD5-18*01 (2) >1'_IGHJ6*01 | 2743 | V2-6_IGLJ4*01 | 854 | 1459 |
| 2929 | VH3-23_IGHD5-18*01 (2) >3'_IGHJ6*01 | 2744 | V2-6_IGLJ4*01 | 854 | 1459 |
| 2930 | VH3-23_IGHD5-24*01>1'_IGHJ6*01 | 2745 | V2-6_IGLJ4*01 | 854 | 1459 |
| 2931 | VH3-23_IGHD5-24*01>3'_IGHJ6*01 | 2746 | V2-6_IGLJ4*01 | 854 | 1459 |
| 2932 | VH3-23_IGHD6-6*01>1'_IGHJ6*01 | 2747 | V2-6_IGLJ4*01 | 854 | 1459 |
| 2933 | VH3-23_IGHD6-6*01>2'_IGHJ6*01 | 2748 | V2-6_IGLJ4*01 | 854 | 1459 |
| 2934 | VH3-23_IGHD6-6*01>3'_IGHJ6*01 | 2749 | V2-6_IGLJ4*01 | 854 | 1459 |
| 2935 | VH3-23_IGHD1-1*01>1_IGHJ6*01 | 2645 | V2-7_IGLJ2*01 | 855 | 1460 |
| 2936 | VH3-23_IGHD1-1*01>2_IGHJ6*01 | 2646 | V2-7_IGLJ2*01 | 855 | 1460 |
| 2937 | VH3-23_IGHD1-1*01>3_IGHJ6*01 | 2647 | V2-7_IGLJ2*01 | 855 | 1460 |
| 2938 | VH3-23_IGHD1-7*01>1_IGHJ6*01 | 2648 | V2-7_IGLJ2*01 | 855 | 1460 |
| 2939 | VH3-23_IGHD1-7*01>3_IGHJ6*01 | 2649 | V2-7_IGLJ2*01 | 855 | 1460 |
| 2940 | VH3-23_IGHD1-14*01>1_IGHJ6*01 | 2650 | V2-7_IGLJ2*01 | 855 | 1460 |
| 2941 | VH3-23_IGHD1-14*01>3_IGHJ6*01 | 2651 | V2-7_IGLJ2*01 | 855 | 1460 |
| 2942 | VH3-23_IGHD1-20*01>1_IGHJ6*01 | 2652 | V2-7_IGLJ2*01 | 855 | 1460 |
| 2943 | VH3-23_IGHD1-20*01>3_IGHJ6*01 | 2653 | V2-7_IGLJ2*01 | 855 | 1460 |
| 2944 | VH3-23_IGHD1-26*01>1_IGHJ6*01 | 2654 | V2-7_IGLJ2*01 | 855 | 1460 |
| 2945 | VH3-23_IGHD1-26*01>3_IGHJ6*01 | 2655 | V2-7_IGLJ2*01 | 855 | 1460 |
| 2946 | VH3-23_IGHD2-2*01>2_IGHJ6*01 | 2656 | V2-7_IGLJ2*01 | 855 | 1460 |
| 2947 | VH3-23_IGHD2-2*01>3_IGHJ6*01 | 2657 | V2-7_IGLJ2*01 | 855 | 1460 |
| 2948 | VH3-23_IGHD2-8*01>2_IGHJ6*01 | 2658 | V2-7_IGLJ2*01 | 855 | 1460 |
| 2949 | VH3-23_IGHD2-8*01>3_IGHJ6*01 | 2659 | V2-7_IGLJ2*01 | 855 | 1460 |
| 2950 | VH3-23_IGHD2-15*01>2_IGHJ6*01 | 2660 | V2-7_IGLJ2*01 | 855 | 1460 |
| 2951 | VH3-23_IGHD2-15*01>3_IGHJ6*01 | 2661 | V2-7_IGLJ2*01 | 855 | 1460 |
| 2952 | VH3-23_IGHD2-21*01>2_IGHJ6*01 | 2662 | V2-7_IGLJ2*01 | 855 | 1460 |
| 2953 | VH3-23_IGHD2-21*01>3_IGHJ6*01 | 2663 | V2-7_IGLJ2*01 | 855 | 1460 |
| 2954 | VH3-23_IGHD3-3*01>1_IGHJ6*01 | 2664 | V2-7_IGLJ2*01 | 855 | 1460 |
| 2955 | VH3-23_IGHD3-3*01>2_IGHJ6*01 | 2665 | V2-7_IGLJ2*01 | 855 | 1460 |
| 2956 | VH3-23_IGHD3-3*01>3_IGHJ6*01 | 2666 | V2-7_IGLJ2*01 | 855 | 1460 |
| 2957 | VH3-23_IGHD3-9*01>2_IGHJ6*01 | 2667 | V2-7_IGLJ2*01 | 855 | 1460 |
| 2958 | VH3-23_IGHD3-10*01>2_IGHJ6*01 | 2668 | V2-7_IGLJ2*01 | 855 | 1460 |
| 2959 | VH3-23_IGHD3-10*01>3_IGHJ6*01 | 2669 | V2-7_IGLJ2*01 | 855 | 1460 |
| 2960 | VH3-23_IGHD3-16*01>2_IGHJ6*01 | 2670 | V2-7_IGLJ2*01 | 855 | 1460 |
| 2961 | VH3-23_IGHD3-16*01>3_IGHJ6*01 | 2671 | V2-7_IGLJ2*01 | 855 | 1460 |
| 2962 | VH3-23_IGHD3-22*01>2_IGHJ6*01 | 2672 | V2-7_IGLJ2*01 | 855 | 1460 |
| 2963 | VH3-23_IGHD3-22*01>3_IGHJ6*01 | 2673 | V2-7_IGLJ2*01 | 855 | 1460 |
| 2964 | VH3-23_IGHD4-4*01 (1) >2_IGHJ6*01 | 2674 | V2-7_IGLJ2*01 | 855 | 1460 |

TABLE 17A-continued

Exemplary Nucleic Acid Paired Library

| HEAVY CHAIN Name | RS SEQ ID NO | LIGHT CHAIN Name | RS SEQ ID NO | NO RS SEQ ID NO |
|---|---|---|---|---|
| 2965 VH3-23__IGHD4-4*01 (1) >3__IGHJ6*01 | 2675 | V2-7__IGLJ2*01 | 855 | 1460 |
| 2966 VH3-23__IGHD4-11*01 (1) >2__IGHJ6*01 | 2676 | V2-7__IGLJ2*01 | 855 | 1460 |
| 2967 VH3-23__IGHD4-11*01 (1) >3__IGHJ6*01 | 2677 | V2-7__IGLJ2*01 | 855 | 1460 |
| 2968 VH3-23__IGHD4-17*01>2__IGHJ6*01 | 2678 | V2-7__IGLJ2*01 | 855 | 1460 |
| 2969 VH3-23__IGHD4-17*01>3__IGHJ6*01 | 2679 | V2-7__IGLJ2*01 | 855 | 1460 |
| 2970 VH3-23__IGHD4-23*01>2__IGHJ6*01 | 2680 | V2-7__IGLJ2*01 | 855 | 1460 |
| 2971 VH3-23__IGHD4-23*01>3__IGHJ6*01 | 2681 | V2-7__IGLJ2*01 | 855 | 1460 |
| 2972 VH3-23__IGHD5-5*01 (2) >1__IGHJ6*01 | 2682 | V2-7__IGLJ2*01 | 855 | 1460 |
| 2973 VH3-23__IGHD5-5*01 (2) >2__IGHJ6*01 | 2683 | V2-7__IGLJ2*01 | 855 | 1460 |
| 2974 VH3-23__IGHD5-5*01 (2) >3__IGHJ6*01 | 2684 | V2-7__IGLJ2*01 | 855 | 1460 |
| 2975 VH3-23__IGHD5-12*01>1__IGHJ6*01 | 2685 | V2-7__IGLJ2*01 | 855 | 1460 |
| 2976 VH3-23__IGHD5-12*01>3__IGHJ6*01 | 2686 | V2-7__IGLJ2*01 | 855 | 1460 |
| 2977 VH3-23__IGHD5-18*01 (2) >1__IGHJ6*01 | 2687 | V2-7__IGLJ2*01 | 855 | 1460 |
| 2978 VH3-23__IGHD5-18*01 (2) >2__IGHJ6*01 | 2688 | V2-7__IGLJ2*01 | 855 | 1460 |
| 2979 VH3-23__IGHD5-18*01 (2) >3__IGHJ6*01 | 2689 | V2-7__IGLJ2*01 | 855 | 1460 |
| 2980 VH3-23__IGHD5-24*01>1__IGHJ6*01 | 2690 | V2-7__IGLJ2*01 | 855 | 1460 |
| 2981 VH3-23__IGHD5-24*01>3__IGHJ6*01 | 2691 | V2-7__IGLJ2*01 | 855 | 1460 |
| 2982 VH3-23__IGHD6-6*01>1__IGHJ6*01 | 2692 | V2-7__IGLJ2*01 | 855 | 1460 |
| 2983 VH3-23__IGHD1-1*01>1'__IGHJ6*01 | 2702 | V2-7__IGLJ2*01 | 855 | 1460 |
| 2984 VH3-23__IGHD1-1*01>2'__IGHJ6*01 | 2703 | V2-7__IGLJ2*01 | 855 | 1460 |
| 2985 VH3-23__IGHD1-1*01>3'__IGHJ6*01 | 2704 | V2-7__IGLJ2*01 | 855 | 1460 |
| 2986 VH3-23__IGHD1-7*01>1'__IGHJ6*01 | 2705 | V2-7__IGLJ2*01 | 855 | 1460 |
| 2987 VH3-23__IGHD1-7*01>3'__IGHJ6*01 | 2706 | V2-7__IGLJ2*01 | 855 | 1460 |
| 2988 VH3-23__IGHD1-14*01>1'__IGHJ6*01 | 2707 | V2-7__IGLJ2*01 | 855 | 1460 |
| 2989 VH3-23__IGHD1-14*01>2'__IGHJ6*01 | 2708 | V2-7__IGLJ2*01 | 855 | 1460 |
| 2990 VH3-23__IGHD1-14*01>3'__IGHJ6*01 | 2709 | V2-7__IGLJ2*01 | 855 | 1460 |
| 2991 VH3-23__IGHD1-20*01>1'__IGHJ6*01 | 2710 | V2-7__IGLJ2*01 | 855 | 1460 |
| 2992 VH3-23__IGHD1-20*01>2'__IGHJ6*01 | 2711 | V2-7__IGLJ2*01 | 855 | 1460 |
| 2993 VH3-23__IGHD1-20*01>3'__IGHJ6*01 | 2712 | V2-7__IGLJ2*01 | 855 | 1460 |
| 2994 VH3-23__IGHD1-26*01>1'__IGHJ6*01 | 2713 | V2-7__IGLJ2*01 | 855 | 1460 |
| 2995 VH3-23__IGHD1-26*01>1'__IGHJ6*01__B | 2714 | V2-7__IGLJ2*01 | 855 | 1460 |
| 2996 VH3-23__IGHD2-2*01>2'__IGHJ6*01__B | 2715 | V2-7__IGLJ2*01 | 855 | 1460 |
| 2997 VH3-23__IGHD2-2*01>3'__IGHJ6*01 | 2716 | V2-7__IGLJ2*01 | 855 | 1460 |
| 2998 VH3-23__IGHD2-8*01>1'__IGHJ6*01 | 2717 | V2-7__IGLJ2*01 | 855 | 1460 |
| 2999 VH3-23__IGHD2-15*01>1'__IGHJ6*01 | 2718 | V2-7__IGLJ2*01 | 855 | 1460 |
| 3000 VH3-23__IGHD2-15*01>3'__IGHJ6*01 | 2719 | V2-7__IGLJ2*01 | 855 | 1460 |
| 3001 VH3-23__IGHD2-21*01>1'__IGHJ6*01 | 2720 | V2-7__IGLJ2*01 | 855 | 1460 |
| 3002 VH3-23__IGHD2-21*01>3'__IGHJ6*01 | 2721 | V2-7__IGLJ2*01 | 855 | 1460 |
| 3003 VH3-23__IGHD3-3*01>1'__IGHJ6*01 | 2722 | V2-7__IGLJ2*01 | 855 | 1460 |
| 3004 VH3-23__IGHD3-3*01>3'__IGHJ6*01 | 2723 | V2-7__IGLJ2*01 | 855 | 1460 |
| 3005 VH3-23__IGHD3-9*01>1'__IGHJ6*01 | 2724 | V2-7__IGLJ2*01 | 855 | 1460 |
| 3006 VH3-23__IGHD3-9*01>3'__IGHJ6*01 | 2725 | V2-7__IGLJ2*01 | 855 | 1460 |
| 3007 VH3-23__IGHD3-10*01>1'__IGHJ6*01 | 2726 | V2-7__IGLJ2*01 | 855 | 1460 |
| 3008 VH3-23__IGHD3-10*01>3'__IGHJ6*01 | 2727 | V2-7__IGLJ2*01 | 855 | 1460 |
| 3009 VH3-23__IGHD3-16*01>1'__IGHJ6*01 | 2728 | V2-7__IGLJ2*01 | 855 | 1460 |
| 3010 VH3-23__IGHD3-16*01>3'__IGHJ6*01 | 2729 | V2-7__IGLJ2*01 | 855 | 1460 |
| 3011 VH3-23__IGHD3-22*01>1'__IGHJ6*01 | 2730 | V2-7__IGLJ2*01 | 855 | 1460 |
| 3012 VH3-23__IGHD4-4*01 (1) >1'__IGHJ6*01 | 2731 | V2-7__IGLJ2*01 | 855 | 1460 |
| 3013 VH3-23__IGHD4-4*01 (1) >3'__IGHJ6*01 | 2732 | V2-7__IGLJ2*01 | 855 | 1460 |
| 3014 VH3-23__IGHD4-11*01 (1) >1'__IGHJ6*01 | 2733 | V2-7__IGLJ2*01 | 855 | 1460 |
| 3015 VH3-23__IGHD4-11*01 (1) >3'__IGHJ6*01 | 2734 | V2-7__IGLJ2*01 | 855 | 1460 |
| 3016 VH3-23__IGHD4-17*01>1'__IGHJ6*01 | 2735 | V2-7__IGLJ2*01 | 855 | 1460 |
| 3017 VH3-23__IGHD4-17*01>3'__IGHJ6*01 | 2736 | V2-7__IGLJ2*01 | 855 | 1460 |
| 3018 VH3-23__IGHD4-23*01>1'__IGHJ6*01 | 2737 | V2-7__IGLJ2*01 | 855 | 1460 |
| 3019 VH3-23__IGHD4-23*01>3'__IGHJ6*01 | 2738 | V2-7__IGLJ2*01 | 855 | 1460 |
| 3020 VH3-23__IGHD5-5*01 (2) >1'__IGHJ6*01 | 2739 | V2-7__IGLJ2*01 | 855 | 1460 |
| 3021 VH3-23__IGHD5-5*01 (2) >3'__IGHJ6*01 | 2740 | V2-7__IGLJ2*01 | 855 | 1460 |
| 3022 VH3-23__IGHD5-12*01>1'__IGHJ6*01 | 2741 | V2-7__IGLJ2*01 | 855 | 1460 |
| 3023 VH3-23__IGHD5-12*01>3'__IGHJ6*01 | 2742 | V2-7__IGLJ2*01 | 855 | 1460 |
| 3024 VH3-23__IGHD5-18*01 (2) >1'__IGHJ6*01 | 2743 | V2-7__IGLJ2*01 | 855 | 1460 |
| 3025 VH3-23__IGHD5-18*01 (2) >3'__IGHJ6*01 | 2744 | V2-7__IGLJ2*01 | 855 | 1460 |
| 3026 VH3-23__IGHD5-24*01>1'__IGHJ6*01 | 2745 | V2-7__IGLJ2*01 | 855 | 1460 |
| 3027 VH3-23__IGHD5-24*01>3'__IGHJ6*01 | 2746 | V2-7__IGLJ2*01 | 855 | 1460 |
| 3028 VH3-23__IGHD6-6*01>1'__IGHJ6*01 | 2747 | V2-7__IGLJ2*01 | 855 | 1460 |
| 3029 VH3-23__IGHD6-6*01>2'__IGHJ6*01 | 2748 | V2-7__IGLJ2*01 | 855 | 1460 |
| 3030 VH3-23__IGHD6-6*01>3'__IGHJ6*01 | 2749 | V2-7__IGLJ2*01 | 855 | 1460 |

4. Antibody Libraries

Provided herein are antibody libraries containing antibodies or portions thereof minimally containing a VH chain and a VL chain or a portion thereof containing a sufficient antigen binding site. The VH chain or portion thereof of the antibody members in the libraries provided herein are encoded by any of the nucleic acid members of the library set forth in Section E.1 above. The VL chain or portion thereof of the antibody members in the libraries provided herein are encoded by any of the nucleic acid members set forth in Section E.2 above. Thus, each antibody member of the library is derived in full or in part from germline segment sequences and/or are derived from modified sequences thereof. In some examples, the libraries are provided as addressed libraries.

In addition, each antibody in the library is productive and functional by virtue of containing a sufficient antigen binding site. The antibodies in the library are different, and when provided in an addressed format, each locus of the library contains a different antibody from all other loci in the library. Thus, the libraries provided herein exhibit high antibody diversity. The antibody libraries provided herein contain as few as $10^2$ different members and typically contain about or $10^3$, $10^4$, $2\times10^4$, $3\times10^4$, $4\times10^4$, $5\times10^4$, $6\times10^4$, $7\times10^4$, $8\times10^4$, $9\times10^4$, $10^5$ and more unique members, including about or $10^6$, $10^7$, $10^8$, $10^9$ and more unique members. The antibody libraries provided herein can be produced by the methods herein, whereby the natural recombination process and natural structural diversity of the antibody repertoire is mimicked.

Besides containing a VH chain and a VL chain, or a portion thereof containing a sufficient antigen-binding site, the resulting antibodies in the library provided herein can contain all or a portion of a constant region. For example, the antibodies can contain one or more of a $C_{H1}$, $C_{H2}$, $C_{H3}$ or $C_L$ portion. Generally, the antibodies or portions thereof contain a $C_{H1}$ portion. The resulting antibodies or portions thereof include, but are not limited to a full-length antibody, Fab, Fab', F(ab')$_2$, single-chain Fvs (scFv), Fv, dsFv, diabody, Fd and Fd' fragments. Exemplary addressed antibody libraries provided herein are Fab libraries.

The number of different members in the antibody libraries provided herein can be restricted such that each member of the library is selected based on sequence similarities or differences or based on shared characteristics (e.g., a V region family, CDR3 length or composition or other biochemical attribute). For example, members of the library can be selected so that individual encoding germline segments of the VL or VH chains of the resulting antibodies have shared characteristics (e.g. are of the same subgroup or gene family) or otherwise contain similar or different sequence identity. In another example, the members of the library can be selected based on the sequence diversity of the VH or VL chains of the resulting antibody members. The antibody members of the library can be selected to be diverse in the represented sequences or to be similar. Thus, in some instances, library members represent a group of highly diverse antibodies. In other instances, library members represent a group similar, non-diverse antibodies. For example, library members can have 40%, 50%, 60%, 70%, 80%, 90%, 91%, 92%, 93%, 94%, 95%, 96%, 97%, 98% or 99% sequence similarity of the VH or VL to all other members in the library. The choice of antibody library is a function of the application and is within the level of one of skill in the art.

In some examples, the addressed libraries provided herein are human naïve libraries. That means that every member of the library is derived completely from human germline segment sequences. For example, the VH chain of each antibody member is encoded by a nucleic acid molecule made up of a combination of a $V_H$, $D_H$ and $J_H$ germline segment, for example, any set forth in Table 3 above, or a subset thereof, such that the resulting nucleic acid molecule has a sequence where the $V_H$ segment is 5' to the $D_H$ segment which is 5' to the $J_H$ segment. The VL chain of each antibody member is encoded by a combination of a $V_\kappa$ and $J_\kappa$ germline segments and/or $V_\lambda$ and $J_\lambda$ germline segments, for example, any set forth in Tables 3-4 above, or a subset thereof, such that the resulting nucleic acid molecule has a sequence where the $V_L$ segment ($V_\kappa$ or $V_\lambda$) is 5' to the $J_L$ segment ($J_\kappa$ or $J_\lambda$). It is understood that the library is considered to be naïve and derived from germline even though, in practicing the method herein, the joint regions of the segments are altered to render the resulting encoding nucleic acid molecules in frame. Such alterations, however, are minor and variously include insertion or deletion generally of only a single nucleotide of a germline segment. In addition, other modification made to the recombined nucleic acid sequence by virtue of practice of the method herein, such as removal of stop codons and restriction enzyme site sequences, also result in naïve antibodies. Naïve antibody libraries provided herein can include the entire repertoire of naïve antibodies, or a subset thereof. For example, a naïve library provided herein can include $10^3$, $10^4$, $2\times10^4$, $3\times10^4$ $4\times10^4$, $5\times10^4$, $6\times10^4$, $7\times10^4$, $8\times10^4$, $9\times10^4$, $10^5$ and more unique members, including about or $10^6$, $10^7$ or more members.

In particular examples, the VH chain of members of the antibody library is encoded by a sequence of nucleotides made up entirely of a $V_H$ and a $J_H$ germline segment, and also any sequence of nucleotides between the $V_H$ and $J_H$ germline segment. The $V_H$ segment is 5' to the random sequence of nucleotides which is 5' to the $J_H$ segment in the encoding nucleic acid molecule. Thus, the resulting antibody members of the library contain a random sequence of amino acids in the region that includes the central portion of the CDRH3, which is largely responsible for the antigen specificity of the resulting antibody. The sequence of nucleotides can be any random sequence of nucleotides. In some instances, the sequence of nucleotides is a sequence that encodes a peptide mimetic against any desired target, for example, a cell surface receptor. Exemplary peptide mimetics are set forth in Table 16. In other examples, the random sequence of nucleotides is a $D_H$ germline segment, or modified form thereof. Generally, the sequence of nucleotides is or is about 5, 10, 15, 20, 25, 30, 40, 50, 60, 70, 80, 90 or more nucleotides in length.

Also provided herein are antibody libraries where the antibodies in the libraries are derived at least in part from modified germline segment sequences. In some examples, all encoding germline segments are modified, for example, by random mutation. In other examples, particular regions of germline segments are targeted for modification. For example, the modified germline segment sequences can include modifications, such as by amino acid mutation, of one or more CDR. In particular, resulting antibody members of the libraries provided herein can contain modification of CDR3, such as of CDRH3. Thus, the resulting members of the library can contain one or more amino acid replacement of a CDR as compared to a naïve antibody.

In some examples, the members of the antibody libraries provided herein can be directed toward a desired target or function by incorporation of sequences into the variable regions of a naive antibody that correspond to a polynucleotide target of interest. Thus, except for the incorporated sequence, which is added by replacement or insertion into the antibody sequence, the remaining antibody represents germline segment sequences. These incorporated sequences include, but are not limited to, peptides as well as portions of monoclonal antibodies.

For example, the antibody can contain a directed peptide that acts as a mimetic against a particular target. Generally, such antibodies act as agonists toward the target, but in some instances, can be antagonists. The peptides can be included in any region of the antibody, but generally are included in the variable region, and more generally in one or more of the CDR regions. In particular, directed peptides are included in the CDR3 region of the antibody. Each member antibody member of the library can be modified with the same directed peptide and/or with different directed peptides.

In related examples, the antibody can contain a sequence portion from a known monoclonal antibodies. The portion can include a portion corresponding to one or more CDRs of a known monoclonal antibody. In other cases, antibodies in the addressed library can contain entire variable region (for example, VL or VH) of a monoclonal antibody. For example, antibodies in the library can contain a VH or VL of a known monoclonal antibody, which can be combined with a VL or VH derived from germline segments as described herein. Exemplary of such an antibody library is one where one or more of the antibody members contain a VH or VL chain from any known monoclonal antibody set forth in Table 9 above.

The antibody libraries of provided herein can include members that represent one, some or all of the above examples.

In the libraries provided herein, the individual VH and VL chains or portions thereof can be the same of different from the VH and VL chains of other antibodies in the library. It is the combination of the VH and VL chain that renders each antibody in the library different, for example, each addressed antibody at a locus. Thus, for example, libraries provided herein can all contain a common VH chain, but can each contain a different VL chain. Thus, the resulting antibody members of the library each contain a different combination of VH and VL chain.

An antibody library provided herein can include a VH encoded from any of nucleic acid sequences SEQ ID NOS: 454-805 (each encoding a VH chain), and a VL chain encoded by any of nucleic acid molecule set forth in any of SEQ ID NOS: 806-815, 817, 819-834, and 836-867 (each encoding a VL chain), or sequences thereof that do not contain heterologous sequence for restriction sites at the 3' and 5' ends, and subsets thereof. An antibody library provided herein also can include a VH encoded from any of nucleic acid sequences SEQ ID NOS: 2070-2759 (each encoding a VH chain), and a VL chain encoded by any of nucleic acid molecule set forth in any of SEQ ID NOS: 806-815, 817, 819-834, and 836-867 (each encoding a VL chain), or sequences thereof not do not contain heterologous sequence for restriction sites at the 3' and 5' ends. Any combination of VH and VL from any of the above recombined nucleic acids provided herein can be paired to generate an antibody library. The components of the library, the size of the library and the type of library (e.g. Fab, full-length antibody, etc) all can be varied Exemplary of such an antibody library provided herein incudes a VH and a VL encoded by a sequence of nucleic acids set forth in Table 17. An additional exemplary antibody library includes a subset of members set forth in Table 17, including a VH and a VL chain encoded from nucleic acid sequences set forth in Table 22 below. For example, in such an exemplary library any of the VH chain sequences set forth in any of SEQ ID NOS: 1475-1826 is paired with any of the VL light chain sequences set forth in SEQ ID NOS:1827-1838, 1840-1855, 1857-1888. The resulting library, when expressed with a CH as exemplified in Example 9, is a Fab library. By virtue of the pairing of VH and VL chain the resulting library can contain at or about $2.1.0 \times 10^5$ or more members, or a subset thereof. Each member pair is encoded by germline segments and represents a naïve antibody.

Exemplary of such an antibody library provided herein includes a VH and a VL encoded by a sequence of nucleic acids set forth in 17.A above.

5. Addressable Formats

The libraries provided herein are provided as addressed libraries such that each loci is a distinct address containing a different member of the library compared to all other loci of the library, and each can be identified by virtue of its address. For example, members at a loci can be identified by prior recording of their distinct location or by an identifiable tag. Where the library is a nucleic acid library, each loci of the library contains a nucleic acid molecule that is different from all other nucleic acid molecules at other loci in the library. Where the library is an antibody library, each loci of the library contains an antibody or portion thereof that is different from all other antibodies or portion thereof at other loci in the library.

The libraries provided herein can be presented in any addressable format known to one of skill in the art. Addressing can be effected by position on a surface or other physical locus or can be otherwise identifiable and/or sortable by other identifiers, such as a tag encoded with a bar code or other symbology, a chemical tag, an electronic, such RF tag, a color-coded tag or other such identifier. One of skill in the art is familiar with various addressable format. Exemplary of such formats is as an array. The library members can be provided on or in the array by immobilization or attachment, or can be provided in solution.

Any nucleic acid molecule or antibody provided herein can be provided in overlapping areas or at random locations on an array, such as a multiwell plate. Alternatively the library members can be provided in spatial array, such that each nucleic acid molecule or antibody is provided in a distinct region of the array which does not overlap with the any other region containing any other antibody or nucleic acid molecules. Any addressable array technology known in the art can be employed with the antibodies.

a. Multiwell Plate

Nucleic acid molecules or antibodies can be spatially arrayed in multiwell plates, such that each individual locus of the plate corresponds to one individual antibody. Multiwell plates can include, but are not limited to, 12-well, 24-well, 48-well, 96-well plates, 384-well plates, and 1536-well plates. In this instance, the identity of each member in each well is known. The members can be attached to the support or provided in solution. For example, one advantage of this technique is that antibodies are presented in solution and are therefore fully folded and functional thereby eliminating the loss of activity observed when proteins are immobilized on filters, chip surfaces or slides. In addition, in the case of antibodies, the antibodies can be screened for any desired activity, including but not limited to binding, cytotoxicity, differentiation or proliferation of cells, and alteration of gene expression. Since the identity of each antibody is known, information on structure activity relationships (SAR) is immediately available. Finally, pharmacokinetics and/or dose response experiments can be performed during screening or immediately following identification of a "hit" or lead compound.

In another instance, nucleic acid molecule and antibody members can be spatially arrayed in multiwell plates, such that each individual locus of the plate corresponds to a group of members. In this instance, the identity of every member within the group in any particular well is known. Groups of members can contain 2, 3, 4, 5, 6, 7, 8, 9, 10, 20, 30, 40, 50, 60, 70, 80, 90, 100 or more antibodies or nucleic acid molecules. For example, antibodies or nucleic acid molecules can be grouped randomly or by any desired characteristic, such as belonging to the same V-region family, containing similar CDR3 region amino acid composition or length, or any other biochemical attributes. For the case of antibodies, the group of addressed antibodies can be screened for any desired activity, including but not limited to binding, cytotoxicity, differentiation or proliferation of cells, and alteration of gene expression. Screening groups of libraries allows for screening a greater number of library members at any given time thereby covering a larger part of the available antibody diversity. Furthermore, following the identification of a "hit" or lead group, since the identity of every antibody within a group is known and the antibodies are all readily available individually, individual antibodies can be immediately screened to identify "active" library members within the group.

ii. Solid Support

Nucleic acid and antibody arrays include those in which members are immobilized on a solid support, such as in a microarray. For example, solid supports for attachment or immobilization include, but are not limited to, blotting on filters, on chip surfaces, or on cellulose and by attachment to slides using affinity tags. In some examples, cells expressing variant polypeptides can be naturally adsorbed to a bead, such that a population of beads contains a single cell per bead (Freeman et al. Biotechnol. Bioeng. (2004) 86:196-200). Following immobilization to a glass support, microcolonies can be grown and screened with a chromogenic or fluorogenic substrate. See, e.g., U.S. Pat. Nos. 6,372,483, 6,352,842, 6,346,416 and 6,242,266.

For example, it is contemplated herein that antibody members of the libraries can be immobilized on a chip. Exemplary of chips include those used for BIAcore. Determining the ability of the protein to bind to a target molecule can be accomplished, e.g., using a technology such as real-time Biomolecular Interaction Analysis (BIA). Sjolander, S. and Urbaniczky, C. (1991) *Anal. Chem.* 63:2338-2345 and Szabo et al. (1995) *Curr. Opin. Struct. Biol.* 5:699-705. Biacore is a method for measuring protein-protein interaction and binding affinity. The technology is based on surface plasmon resonance (SPR), an optical phenomenon that enables detection of unlabeled interactants in real time (Welford K. 1991, Opt. Quant. Elect. 23:1; Morton and Myszka, 1998, Methods in Enzymology 295: 268). The SPR-based biosensors can be used to monitor biomolecular interactions in real time to determine active concentration, screening and characterization in terms of both affinity and kinetics. BIAcore analysis conveniently generates association rate constants, dissociation rate constants, equilibrium dissociation constants, and affinity constants.

The methodology relies on immobilization of ligands onto the surface of a sensor chip consisting of a glass substrate having a gold film covered by a monolayer of a long hydroxyalkyl thiol to which is covalently attached a thin layer of carboxymethylated dextran. The immobilization procedure is performed with the sensor chip in place in the instrument and is continuously monitored by the SPR detector. An unknown sample or ligate solution is introduced into the apparatus to contact the immobilized ligand. The interaction between ligand and ligate is observed directly by surface plasmon resonance techniques and the measurements recorded on a computer via a program such as Bialogue [Pharmacia].

6. Other Display Methods

The libraries also can be provided in other non-addressable formats. Exemplary of such other non-addressable formats include display by display, in particular, any display format that facilitates screening of the members of the libraries for an activity or activities. Generally, such formats are used for the antibody libraries, but if desired can also be provided for the nucleic acid or vector libraries. Typically libraries are screened using a display technique, such that there is a physical link between individual molecules of the library (phenotype) and the genetic information encoding them (genotype). These methods include, but are not limited to, cell display, phage display, mRNA display, ribosome display and DNA display.

a. Cell Display

Antibody libraries for screening can be expressed on the surfaces of cells, including bacteria *E. coli*, yeast *S. cerevisiae*, and mammalian cells, by fusing them with a protein that is expressed on the surface of the cell. Cell display is a technology used to screen antibody libraries wherein immobilization of the target antigen is unnecessary. Instead a technique, such as fluorescence-activated cell sorting (FACS), can be used to identify desired antibodies. FACS permits the separation of subpopulations of cells on the basis of their light scatter properties as they pass through a laser beam. See e.g. United States Published Patent Application Nos. US 2003/0100023 and US 2003/0036092. Single chain antibodies can be expressed on the external surface of *E. coli* by fusing them to a protein previously shown to direct heterologous proteins to the bacterial surface (Francisco et al., (1993) *Proc. Natl. Acad. Sci., USA*, 90:10444-10448). Single chain and Fab antibodies can be displayed on the surface of a yeast cell, and homologous recombination in yeast can be exploited to generate libraries of transformants (see e.g. Kieke et al., (1997) *Prot. Eng.*, 10:1303-1310; Weaver-Feldhaus et al., (2004) *FEBS Lett.*, 564:24-34; and Swers et al., (2004) *Nucleic Acids Res.*, 32:e36). Mammalian cell display has been utilized to screen scFv libraries as well as IgGs (Ho et al., (2005) *J. Biol. Chem.*, 280:07-617).

b. Phage Display

Phage display is a widely used method for screening antibody libraries for their ability to bind to a particular antigen. Phage display is a cell based method in which proteins or peptides are expressed individually on the surface of phage as fusions to a coat protein, while the same phage particle carries the DNA encoding the protein or peptide (Smith, G. P. (1985) *Science* 228:1315-1317). Selection of the phage is achieved through a specific binding reaction involving recognition of the protein or peptide, enabling the particular phage to be isolated and cloned and the DNA for the protein or peptide to be recovered and propagated or expressed. Use of phage display is rapid and facile due to its reliance upon E. coli for amplification and propagation. Typical use involves panning phage libraries against an immobilized antigen.

c. mRNA Display and Ribosome Display

The use of mRNA display and ribosome display allow for totally in vitro construction of antibody libraries. mRNA display is a method of displaying proteins or peptides in which the nascent protein is caused to bind covalently to its mRNA through a puromycin link (Roberts et al. (1997) *Proc. Natl. Acad. Sci, U.S.A.* 64:12297-12302). Puromycin acts as a mimic of aminoacyl tRNA, enters the ribosome A site, and the nascent protein is bound covalently to it by the peptidyl-transferase activity of the ribosome. Selection is carried out on these protein-mRNA fusions after dissociation of the ribosome. Alternatively, ribosome display is a method of displaying proteins or peptides in nascent form on the surface of ribosomes, such that a stable complex with the encoding mRNA is formed; the complexes are selected with a ligand for the protein or peptide and the genetic information is obtained by reverse transcription of the isolated mRNA (see e.g. U.S. Pat. Nos. 5,643,768 and 5,658,754). Selection techniques are similar to that of phage display wherein an ribosome display libraries are panned against an immobilized antigen.

d. DNA Display

In DNA display the DNA encoding the peptide is linked to the peptide. In non-covalent DNA display, the DNA-protein linkage is promoted by the recognition of the bacterial RepA protein as well as its own origin of replication sequence integrated into the template DNA (Odegrip et al. (2004) *Proc. Natl. Acad. Sci, U.S.A.* 101:2806-2810). Alternatively, a biotin-streptavidin interaction can be utilized. In covalent DNA display a bacteriophage P2 protein genetically fused to an antibody fragment binds to its own DNA sequence (Reiersen et al. (2005) *Nucl. Acids Res.* 33:e10). Alternatively, the DNA and the peptide can be compartmentalized, such as in an oil-in-water emulsion. Selection techniques are similar to that of phage display wherein DNA display libraries are panned against an immobilized antigen. See e.g. International Patent Publication No. WO 98/037186.

F. Methods of Production of Antibodies

Nucleic acid molecules and antibody members of the libraries provided herein can be made by any method known to one of skill in the art. Such procedures are routine and are well known to the skill artisan. They include routine molecular biology techniques including gene synthesis, PCR, ligation, cloning, transfection and purification techniques. A description of such procedures is provided below.

For example, nucleic acid sequences can be constructed using gene synthesis techniques as discussed herein above. Gene synthesis or routine molecular biology techniques also can be used to effect insertion, deletion, addition or replacement of nucleotides. For example, additional nucleotide sequences can be joined to a nucleic acid sequence. In one example linker sequences can be added, such as sequences containing restriction endonuclease sites for the purpose of cloning the synthetic gene into a vector, for example, a protein expression vector or a vector designed for the amplification of the antibody constant region coding DNA sequences. Furthermore, additional nucleotide sequences specifying functional DNA elements can be operatively linked to a recombined germline encoding nucleic acid molecule. Examples of such sequences include, but are not limited to, promoter sequences designed to facilitate intracellular protein expression, and leader peptide sequences designed to facilitate protein secretion. Additional nucleotide sequences such as sequences specifying protein binding regions also can be linked to nucleic acid sequences. Such regions include, but are not limited to, sequences to facilitate uptake of recombined antibodies or fragments thereof into specific target cells, or otherwise enhance the pharmacokinetics of the synthetic gene.

Nucleic acid sequences can be further engineered as described herein, such as by mutagenesis, to generate mutant antibodies. Mutagenesis can be effected entirely through gene synthesis. For example, nucleic acid molecules can be designed manually or in silico for synthesis to encode mutant antibodies. The benefit of using gene synthesis methods is that the mutations can be effected so that the resulting nucleic acid molecules are in-frame and are "productive" as discussed herein above. Other methods of synthesis exist where randomization can be achieved during the gene synthesis. For example, a protocol has been developed by which synthesis of an oligonucleotide is "doped" with non-native phosphoramidites, resulting in randomization of the gene section targeted for random mutagenesis (Wang and Hoover (1997) J. Bacteriol., 179:5812-9). This method allows control of position selection while retaining a random substitution rate. Alternatively, mutagenesis can be effected through other molecular biology techniques. Generally, site-directed mutagenesis strategies can be employed.

Other current methods can be used to create mutant antibody libraries from a template nucleic acid molecule or molecules, such as a germline recombined nucleic acid molecule encoding a naïve antibody. Such methods include, but are not limited to, error-prone polymerase chain reaction (Caldwell and Joyce (1992); Gram et al. (1992) Proc. Natl. Acad. Sci., 89:3576-80); cassette mutagenesis in which the specific region to be optimized is replaced with a synthetically mutagenized oligonucleotide (Stemmer and Morris (1992) Biotechniques, 13:214-20); Arkin and Youvan (1992) Proc. Natl. Acad. Sci., 89:7811-7815; Oliphant et al. (1986) Gene, 44:177-83; Hermes et al. (1990) Proc. Natl. Acad. Sci, 87:696-700); the use of mutator strains of hosts cells to add mutational frequency (Greener et al. (1997) Mol. Biotechnol., 7:189-95); DNA shuffling (Crameri et al. (1998) Nature, 391:288-291; U.S. Pat. Nos. 6,177,263; 5,965,408; Ostermeier et al. (1999) Nat. Biotechnol., 17:1205-1209); and other random mutagenesis methods.

1. Vectors

Provided herein are vectors that contain nucleic acid encoding the recombined antibodies or portions thereof. The nucleic acids encoding antibody polypeptides are typically cloned into a intermediate vector before transformation into prokaryotic or eukaryotic cells. Choice of vector can depend on the desired application. For example, after insertion of the nucleic acid, the vectors typically are used to transform host cells, for example, to amplify the recombined antibody genes for replication and/or expression thereof. In such examples, a vector suitable for high level expression is used. In other cases, a vector is chosen that is compatible with display of the expressed polypeptide on the surface of the cell.

Many expression vectors are available and known to those of skill in the art for the expression of recombined antibodies or portions thereof. The choice of an expression vector is influenced by the choice of host expression system. Such selection is well within the level of skill of the skilled artisan. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vectors in the cells. Vectors also generally can contain additional nucleotide sequences operably linked to the ligated nucleic acid molecule (e.g. His tag, Flag tag). For purposes herein, vectors generally include sequences encoding the constant region. Thus, recombined antibodies or portions thereof also can be expressed as protein fusions. For example, a fusion can be generated to add additional functionality to a polypeptide. Examples of fusion proteins include, but are not limited to, fusions of a signal sequence, an epitope tag such as for localization, e.g. a $his_6$ tag or a myc tag, or a tag for purification, for example, a GST fusion, and a sequence for directing protein secretion and/or membrane association.

For example, expression of the proteins can be controlled by any promoter/enhancer known in the art. Suitable bacterial promoters are well known in the art and described herein below. Other suitable promoters for mammalian cells, yeast cells and insect cells are well known in the art and some are exemplified below. Selection of the promoter used to direct expression of a heterologous nucleic acid depends on the particular application. Promoters which can be used include but are not limited to eukaryotic expression vectors containing the SV40 early promoter (Bernoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vectors such as the b-lactamase promoter (Jay et al., (1981) *Proc. Natl. Acad. ScL USA* 78:5543) or the tac promoter (DeBoer et al., *Proc. Natl. Acad. Sci. USA* 80:21-25 (1983)); see also "Useful Proteins from Recombinant Bacteria": in Scientific American 242:79-94 (1980)); plant expression vectors containing the nopaline synthetase promoter (Herrara-Estrella et al., *Nature* 303:209-213 (1984)) or the cauliflower mosaic virus 35S RNA promoter (Gardner et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 38:639-646 (1984); Ornitz et al., *Cold Spring Harbor Symp. Quant. Biol.* 50:399-409 (1986); MacDonald, *Hepatology* 7:425-515 (1987)); insulin gene control region which is active in pancreatic beta cells (Hanahan et al., *Nature* 315:115-122 (1985)), immunoglobulin gene control region which is active in lymphoid cells (Grosschedl et al., *Cell* 38:647-658 (1984); Adams et al., *Nature* 318:533-538 (1985); Alexander et al., *Mol. Cell Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinckert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 1987)), alpha-1 antitrypsin gene control region which is active in liver (Kelsey et al., *Genes and Devel.* 1:161-171 (1987)), beta globin gene control region which is active in myeloid cells (Magram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain-2 gene control region which is active in skeletal muscle (Shani, *Nature* 314:283-286 (1985)), and gonadotrophic releasing hormone gene control region which is active in gonadotrophs of the hypothalamus (Mason et al., *Science* 234:1372-1378 (1986)).

In addition to the promoter, the expression vector typically contains a transcription unit or expression cassette that contains all the additional elements required for the expression of the antibody, or portion thereof, in host cells. A typical expression cassette contains a promoter operably linked to the nucleic acid sequence encoding the germline antibody chain and signals required for efficient polyadenylation of the transcript, ribosome binding sites and translation termination. Additional elements of the cassette can include enhancers. In addition, the cassette typically contains a transcription termination region downstream of the structural gene to provide for efficient termination. The termination region can be obtained from the same gene as the promoter sequence or can be obtained from different genes.

Some expression systems have markers that provide gene amplification such as thymidine kinase and dihydrofolate reductase. Alternatively, high yield expression systems not involving gene amplification are also suitable, such as using a baculovirus vector in insect cells, with a nucleic acid sequence encoding a germline antibody chain under the direction of the polyhedron promoter or other strong baculovirus promoter.

For purposes herein, vectors are provided that contain a sequence of nucleotides that encodes a constant region of an antibody operably linked to the nucleic acid sequence encoding the recombined variable region of the antibody. The vector can include the sequence for one or all of a CH1, CH2, CH3 or CH4 and/or CL. Generally, such as for expression of Fabs, the vector contains the sequence for a CH1 or CL. Exemplary of such vectors containing a heavy chain constant region gene (e.g. CH1) are plasmids A and D, described herein. Exemplary of such vectors containing a light chain constant region genes are plasmids C and E, described herein.

Exemplary expression vectors include any mammalian expression vector such as, for example, pCMV. For bacterial expression, such vectors include pBR322, pUC, pSKF, pET23D, and fusion vectors such as MBP, GST and LacZ. Exemplary of such a vector are bacterial expression vectors such as, for example, plasmid A, plasmid C, plasmid D and plasmid E, described herein. Other eukaryotic vectors, for example any containing regulatory elements from eukaryotic viruses can be used as eukaryotic expression vectors. These include, for example, SV40 vectors, papilloma virus vectors, and vectors derived from Epstein-Bar virus. Other exemplary eukaryotic vectors include pMSG, pAV009/A+, pMT010/A+, pMAMneo-5, baculovirus pDSCE, and any other vector allowing expression of proteins under the direction of the CMV promoter, SV40 early promoter, SV40 late promoter, metallothionein promoter, murine mammary tumor virus promoter, Rous sarcoma virus promoter, polyhedron promoter, or other promoters shown effective for expression in eukaryotes.

Figure 3:
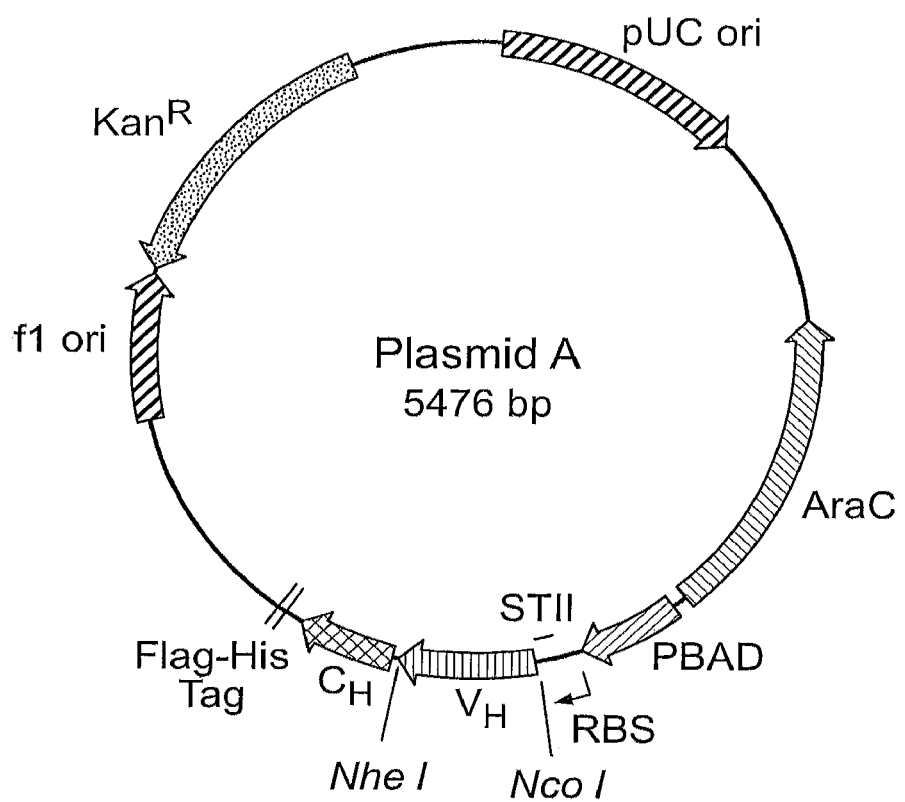
FIG. 3: Plasmid A Vector Map
Figure 4:
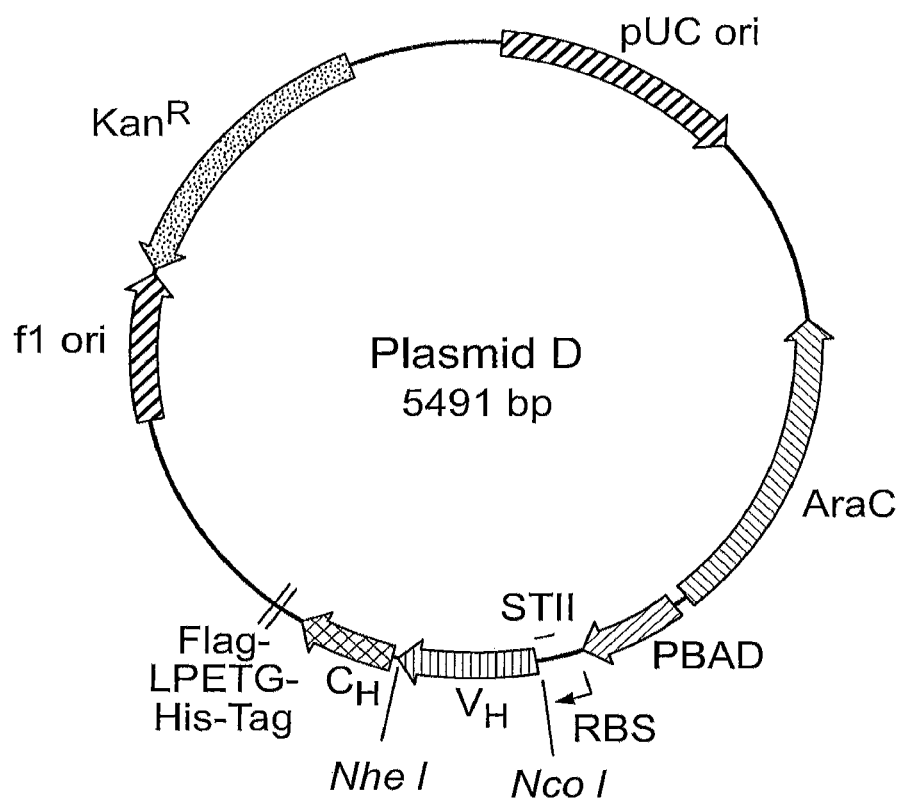
FIG. 4: Plasmid D Vector Map
Figure 5:
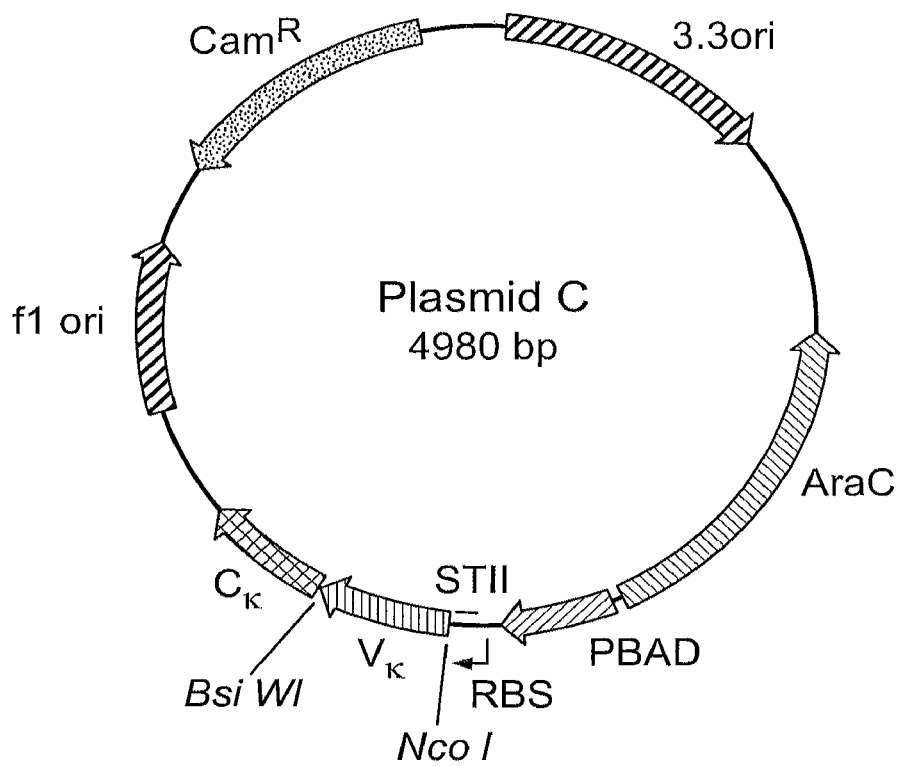
FIG. 5: Plasmid C Vector Map
Figure 6:
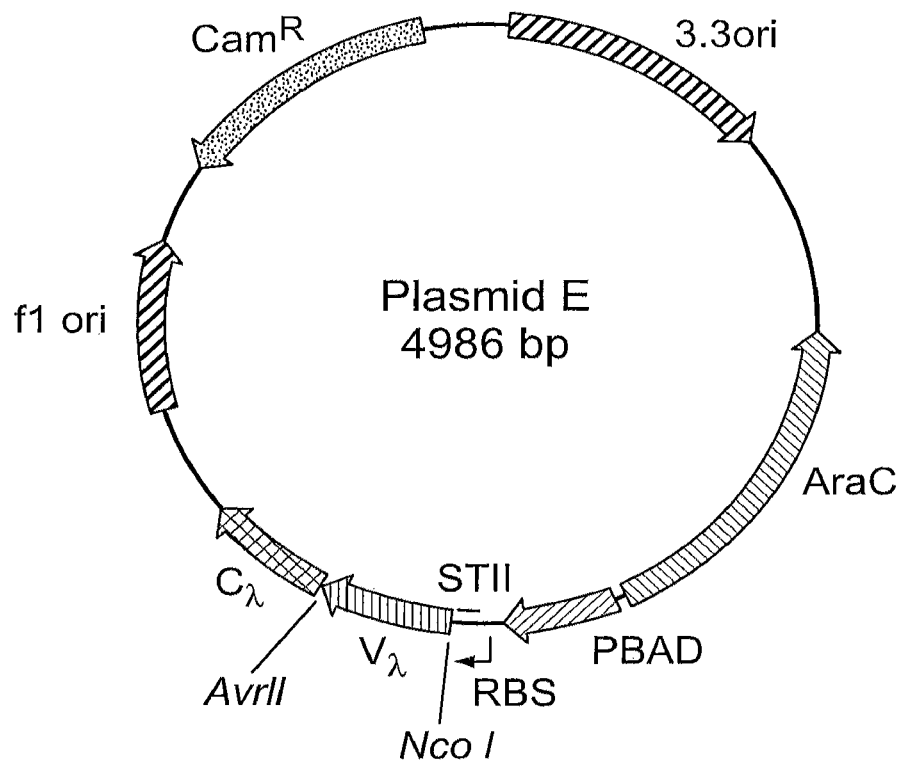
FIG. 6: Plasmid E Vector Map

Exemplary plasmid vectors for transformation of *E. coli* cells, include, for example, the ColE1 replication vectors described herein. Several features common to all these vectors include (a) a pBAD inducible promoter; (b) an AraC gene, which controls the pBAD promoter; (c) a synthetic ribosomal binding site (RBS) for efficient translation; (d) a ColE1 origin of replication, allowing for high copy expression; (e) a STII leader sequence, allowing for expressed proteins to be translocated to the periplasm; (f) a f1 origin of replication; and (g) a gene for conferring antibiotic resistance. Such plasmids include plasmid A (FIG. 3), plasmid C (FIG. 5), plasmid D (FIG. 4) and plasmid E (FIG. 6). Plasmid A and Plasmid D are utilized for expression of heavy chain antibody genes in as they contain a gene for the heavy chain constant region (CH1) operably linked to the inserted gene for the heavy chain variable region. The vectors contain NheI and NcoI restriction sites to allow for cloning of the recombined antibody genes described herein. Both vectors contain a pUC origin of replication, a ColE1 type origin of replication, and an aminoglycoside phosphotransferase gene conferring kanamycin resistance. Plasmid A contains a $(His)_6$ Tag and a Flag Tag for protein purification. Plasmid D contains both a $(His)_6$ Tag and a Flag Tag, and an additional LPETG tag, which allows for covalent attachment of the resulting protein using a sortase. Plasmid C and Plasmid E are utilized for expression of light chain antibody genes in as they contain a gene for the light chain constant region (CL) operably linked to the inserted gene for the light chain variable region. Plasmid C is specific for kappa light chains and contains BseWI and NcoI restriction sites to allow for cloning of the recombined antibody genes described herein. Plasmid E is specific for lambda light chains and contains AcrII and NcoI restriction sites to allow for cloning of the recombined antibody genes described herein. Both vectors contain a 3.3 origin of replication, a ColE1 type origin of replication, and a gene conferring chloramphenicol resistance. The vectors described above are designed to be utilized in a dual vector system, in which a light chain vector and a heavy chain vector are co-transformed. Thus, they contain two different but compatible ColE1 origins of replication utilized, one for heavy chains and one light chain. This allows for efficient expression of both chains of the antibody when the vectors are co-transformed and expressed.

Any methods known to those of skill in the art for the insertion of DNA fragments into a vector can be used to construct expression vectors containining a nucleic acid encoding an antibody chain. These methods can include in vitro recombinant DNA and synthetic techniques and in vivo recombinants (genetic recombination). The insertion into a cloning vector can, for example, be accomplished by ligating the DNA fragment into a cloning vector which has complementary cohesive termini. If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized nucleic acids encoding restriction endonuclease recognition sequences.

2. Cells and Expression Systems

Cells containing the vectors also are provided. Generally, any cell type that can be engineered to express heterologous DNA and has a secretory pathway is suitable. Expression hosts include prokaryotic and eukaryotic organisms such as bacterial cells (e.g. *E. coli*), yeast cells, fungal cells, Archea, plant cells, insect cells and animal cells including human cells. Expression hosts can differ in their protein production levels as well as the types of post-translational modifications that are present on the expressed proteins. Further, the choice of expression host is often related to the choice of vector and transcription and translation elements used. For example, the choice of expression host is often, but not always, dependent on the choice of precursor sequence utilized. For example, many heterologous signal sequences can only be expressed in a host cell of the same species (i.e., an insect cell signal sequence is optimally expressed in an insect cell). In contrast, other signal sequences can be used in heterologous hosts such as, for example, the human serum albumin (hHSA) signal sequence which works well in yeast, insect, or mammalian host cells and the tissue plasminogen activator pre/pro sequence which has been demonstrated to be functional in insect and mammalian cells (Tan et al., (2002) *Protein Eng.* 15:337). The choice of expression host can be made based on these and other factors, such as regulatory and safety considerations, production costs and the need and methods for purification. Thus, the vector system must be compatible with the host cell used.

Expression in eukaryotic hosts can include expression in yeasts such as *Saccharomyces cerevisiae* and *Pichia pastoris*, insect cells such as *Drosophila* cells and *lepidopteran* cells, plants and plant cells such as tobacco, corn, rice, algae, and lemna. Eukaryotic cells for expression also include mammalian cells lines such as Chinese hamster ovary (CHO) cells or baby hamster kidney (BHK) cells. Eukaryotic expression hosts also include production in transgenic animals, for example, including production in serum, milk and eggs.

Recombinant molecules can be introduced into host cells via, for example, transformation, transfection, infection, electroporation and sonoporation, so that many copies of the gene sequence are generated. Generally, standard transfection methods are used to produce bacterial, mammalian, yeast, or insect cell lines that express large quantity of antibody chains, which is then purified using standard techniques (see e.g., Colley et al. (1989) J. Biol. Chem., 264:17619-17622; Guide to Protein Purification, in Methods in Enzymology, vol. 182 (Deutscher, ed.), 1990). Transformation of eukaryotic and prokaryotic cells are performed according to standard techniques (see, e.g., Morrison (1977) J. Bact. 132: 349-351; Clark-Curtiss and Curtiss (1983) Methods in Enzymology, 101, 347-362). For example, any of the well-known procedures for introducing foreign nucleotide sequences into host cells can be used. These include the use of calcium phosphate transfection, polybrene, protoplast fusion, electroporation, biolistics, liposomes, microinjection, plasma vectors, viral vectors and any other the other well known methods for introducing cloned genomic DNA, cDNA, synthetic DNA or other foreign genetic material into a host cell. Generally, for purposes herein, host cells are transfected with a first vector encoding at least a VH chain and a second vector encoding at least a VL chain. Thus, it is only necessary that the particular genetic engineering procedure used be capable of successfully introducing at least both genes into the host cell capable of expressing germline, or modified form thereof, antibody polypeptide.

Transformation of host cells with recombinant DNA molecules that incorporate the isolated recombined variable region gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA. Generally, After the expression vector is introduced into the cells, the transfected cells are cultured under conditions favoring expression of the germline chain, which is recovered from the culture using standard purification techniques identified below.

Antibodies and portions thereof can be produced using a high throughput approach by any methods known in the art for protein production including in vitro and in vivo methods such as, for example, the introduction of nucleic acid molecules encoding recombined antibodies or portions thereof into a host cell or host animal and expression from nucleic acid molecules encoding recombined antibodies in vitro. Prokaryotes, especially *E. coli*, provide a system for producing large amounts of recombined antibodies or portions thereof, and are particularly desired in applications of high-throughput expression and purification of proteins. Transformation of *E. coli* is a simple and rapid technique well known to those of skill in the art. *E. coli* host strains for high throughput expression include, but are not limited to, BL21 (EMD Biosciences) and LMG194 (ATCC). Exemplary of such an *E. coli* host strain is BL21. Vectors for high throughput expression include, but are not limited to, pBR322 and pUC vectors. Exemplary of such vectors are the vectors described herein, including plasmid A, plasmid C, plasmid D and plasmid E. Automation of expression and purification can facilitate high-throughput expression. For example, use of a Piccolo™ system, a fully automatic system that combines cell culture with automated harvesting, lysing and purification units, or other similar robotic system can be employed.

a. Prokaryotic Expression

Prokaryotes, especially *E. coli*, provide a system for producing large amounts of recombined antibodies or portions thereof. Transformation of *E. coli* is a simple and rapid technique well known to those of skill in the art. Expression vectors for *E. coli* can contain inducible promoters that are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated $P_L$ promoter.

Recombined antibodies or portions thereof can be expressed in the cytoplasmic environment of *E. coli*. The cytoplasm is a reducing environment and for some molecules, this can result in the formation of insoluble inclusion bodies. Reducing agents such as dithiothreitol and -mercaptoethanol and denaturants (e.g., such as guanidine-HCl and urea) can be used to resolubilize the proteins. An exemplary alternative approach is the expression of recombined antibodies or fragments thereof in the periplasmic space of bacteria which provides an oxidizing environment and chaperonin-like and disulfide isomerases leading to the production of soluble protein. Typically, a leader sequence is fused to the protein to be expressed which directs the protein to the periplasm. The leader is then removed by signal peptidases inside the periplasm. There are three major pathways to translocate expressed proteins into the periplasm, namely the Sec pathway, the SRP pathway and the TAT pathway. Examples of periplasmic-targeting leader sequences include the pelB leader from the pectate lyase gene, the StII leader sequence, and the DsbA leader sequence. An exemplary leader sequence is a DsbA leader sequence. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility. Typically, temperatures between 25° C. and 37° C. are used. Mutations also can be used to increase solubility of expressed proteins. Typically, bacteria produce aglycosylated proteins. Thus, if proteins require glycosylation for function, glycosylation can be added in vitro after purification from host cells.

b. Yeast

Yeasts such as *Saccharomyces cerevisiae, Schizosaccharomyces pombe, Yarrowia lipolytica, Kluyveromyces lactis*, and *Pichia pastoris* are useful expression hosts for recombined antibodies or portions thereof. Yeast can be transformed with episomal replicating vectors or by stable chromosomal integration by homologous recombination. Typically, inducible promoters are used to regulate gene expression. Examples of such promoters include AOX1, GAL1, GAL7, and GAL5 and metallothionein promoters such as CUP1. Expression vectors often include a selectable marker such as LEU2, TRP1, HIS3, and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insects

Insect cells, particularly using baculovirus expression, are useful for expressing antibodies or portions thereof. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter and p10 promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda* and TN derived from *Trichoplusia ni*. For high-level expression, the nucleotide sequence of the molecule to be expressed is fused immediately downstream of the polyhedrin initiation codon of the virus. To generate baculovirus recombinants capable of expressing human antibodies, a dual-expression transfer, such as pAcUW51 (PharMingen) is utilized. Mammalian secretion signals are accurately processed in insect cells and can be used to secrete the expressed protein into the culture medium An alternative expression system in insect cells is the use of stably transformed cells. Cell lines such as Sf9 derived cells from *Spodoptera frugiperda* and TN derived cells from *Trichoplusia ni* can be used for expression. The baculovirus immediate early gene promoter IE1 can be used to induce consistent levels of expression. Typical expression vectors include the pIE1-3 and pI31-4 transfer vectors (Novagen). Expression vectors are typically maintained by the use of selectable markers such as neomycin and hygromycin.

d. Mammalian Cells

Mammalian expression systems can be used to express antibodies or portions thereof. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase and thymidine kinase. Antibodies are typically produced using a NEO$^R$/G418 system, a dihydrofolate reductase (DHFR) system or a glutamine synthetase (GS) system. The GS system uses joint expression vectors, such as pEE12/pEE6, to express both heavy chain and light chain. Fusion with cell surface signaling molecules such as TCR- and Fc RI- can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. One such example is the serum free EBNA-1 cell line (Pham et al., (2003) *Biotechnol. Bioeng.* 84:332-42.)

e. Plants

Transgenic plant cells and plants can be used to express proteins such as any antibody or portion thereof described herein. Expression constructs are typically transferred to plants using direct DNA transfer such as microprojectile bombardment and PEG-mediated transfer into protoplasts, and with agrobacterium-mediated transformation. Expression vectors can include promoter and enhancer sequences, transcriptional termination elements and translational control elements. Expression vectors and transformation techniques are usually divided between dicot hosts, such as Arabidopsis and tobacco, and monocot hosts, such as corn and rice. Examples of plant promoters used for expression include the cauliflower mosaic virus CaMV 35S promoter, the nopaline synthase promoter, the ribose bisphosphate carboxylase promoter and the maize ubiquitin-1 (ubi-1) promoter promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce proteases or modified proteases (see for example, Mayfield et al. (2003) *PNAS* 100:438-442). Because plants have different glycosylation patterns than mammalian cells, this can influence the choice of protein produced in these hosts.

3. Purification

Antibodies and portions thereof are purified by any procedure known to one of skill in the art. The recombed germline antibodies can be purified to substantial purity using standard protein purification techniques known in the art including but not limited to, SDS-PAGE, size fraction and size exclusion chromatography, ammonium sulfate precipitation, chelate chromatography, ionic exchange chromatography or column chromatography. For example, antibodies can be purified by column chromatography. Exemplary of a method to purify antibodies is by using column chromatography, wherein a solid support column material is linked to Protein G, a cell surface-associated protein from Streptococcus, that binds immunoglobulins with high affinity. The antibodies can be purified to 60%, 70%, 80% purity and typically at least 90%, 91%, 92%, 93%, 94%, 95%, 96%, 97%, 98% or 99% purity. Purity can be assessed by standard methods such as by SDS-PAGE and coomassie staining.

Methods for purification of recombined antibodies or portions thereof from host cells depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary further the proteins can be extracted and further purified using standard methods in the art.

When antibodies are expressed by transformed bacteria in large amounts, typically after promoter induction, although expression can be constitutive, the polypeptides can form insoluble aggregates. There are several protocols that are suitable for purification of polypeptide inclusion bodies known to one of skill in the art. Numerous variations will be apparent to those of skill in the art.

For example, in one method, the cell suspension is generally centrifuged and the pellet containing the inclusion bodies resuspended in buffer which does not dissolve but washes the inclusion bodies, e.g., 20 mM Tris-HCL (pH 7.2), 1 mM EDTA, 150 mM NaCl and 2% Triton-X 100, a non-ionic detergent. It can be necessary to repeat the wash step to remove as much cellular debris as possible. The remaining pellet of inclusion bodies can be resuspended in an appropriate buffer (e.g., 20 mM sodium phosphate, pH 6.8, 150 mM NaCl). Other appropriate buffers are apparent to those of skill in the art.

Alternatively, antibodies can be purified from bacteria periplasm. Where the polypeptide is exported into the periplasm of the bacteria, the periplasmic fraction of the bacteria can be isolated by cold osmotic shock in addition to other methods known to those of skill in the art. For example, in one method, to isolate recombinant polypeptides from the periplasm, the bacterial cells are centrifuged to form a pellet. The pellet is resuspended in a buffer containing 20% sucrose. To lyse the cells, the bacteria are centrifuged and the pellet is resuspended in ice-cold 5 mM $MgSO_4$ and kept in an ice bath for approximately 10 minutes. The cell suspension is centrifuged and the supernatant decanted and saved. The recombinant polypeptides present in the supernatant can be separated from the host proteins by standard separation techniques well known to those of skill in the art. These methods include, but are not limited to, the following steps: solubility fractionation, size differential filtration, and column chromatography.

G. Applications and Uses of the Libraries

Provided herein are methods of using the antibody libraries provided herein for screening to identify or select an antibody or antibodies that alter or modulate (increase or decrease) an activity of a target. As discussed above, the antibody libraries provided herein contain members 1) that are each different from all other members in the library; and 2) that are each productive and functional. By virtue of these characteristics the libaries are both diverse and robust in their screening capabilties. For example, using the libraries provided herein, it is possible to screen a small library (e.g. containing 1000 or fewer members) and identify antibodies having desired functions or activities. This is exemplified in Example 13 where a library of only 960 members was used in a screening assay for binding to various targets, resulting in the identification of several high affinity (nanomolar affinity) antibodies.

In the method of screening herein, any desired activity can be assayed for, including but not limited to binding, cytotoxicity, differentiation or proliferation of cells, cell migration, apoptosis, angiogenesis and alteration of gene expression.

For example, the resulting libraries can be screened for the discovery of agonist or antagonist antibodies against therapeutic targets, such as, for example, targets involved in cell proliferation and differentiation, cell migration, apoptosis and angiogeneis. Such targets include, but not limited to, growth factors, cytokines, lymphocytic antigens, other cellular activators and receptors thereof.

In other examples, the libraries can be screened using "blind" functional screens to measure an observable biological processes of interest without requiring specific knowledge of the target in advance. Any Hit that is identified in such screening assays, for example by virtue of a strong functional activity, can be further analyzed to identify the specific target. The "blind" assay approach can be applied to any observable biological outcome. For example, apoptosis of B-cells can be readily assayed, and a screen for increased B-cell apoptosis can yield antibody Hits that promote B-cell killing. Such antibodies can bind known B-cell surface-proteins like CD-20, or bind a novel target. In another example, the increased (or decreased) secretion of specific cytokines, for example interferon alpha, from a population of cells such as bone marrow cells can be assayed by ELISA, allowing screening for antibodies which modify the secretion of these proteins. No a priori knowledge of the mechanism that achieves the screened outcome is necessary, and the specific antibody target can later be pursued if the effect is strong. The blind functional assays can also be merged with high-content screening approaches to find antibodies that induce morphological changes in a certain cell type or promote cell differentiation in a progenitor cell population.

The methods of screening provided herein involve contacting each member of an antibody library provided herein with a target protein, peptide or antigen or cell expressing a target protein, peptide or antigen or simply a cell population and identifying antibody members that modulate (increase or decrease) the activity of the target protein or cell. For example, the members of the library can be contacted to identify antibodies that bind to the target protein. In another example, antibodies can be screened for modulation of a functional activity of a target. Functional assays permit identification of agonist and antagonist antibodies. It is contemplated herein that this screening assay is particularly useful against membrane-bound proteins, such as receptor targets and other signaling molecules.

The antibody libraries provided herein can be presented in a format that permits screening, such as, for example, as addressable libraries, including spatial arrays; and cell display libraries, including yeast display and mammalian display, phage display, mRNA display, including ribosome display, and DNA display. For example, screening is performed on addressable antibody libraries, such as a spatial arrayed library, whereby each antibody member at a locus (e.g. well) is separately contacted and screened against a target protein or proteins from all other members in the library. Thus, upon identification of a "HIT" the identity of the antibody member is immediately known from its location in the array without any requirement for further enrichment, amplification or sequencing thereof. Library screening can be high-throughput by screening hundreds to thousands or more antibodies in the same screening assay.

Any technique known to one of skill in the art can be used for antibody screening herein to identify antibody members having a desired activity. For a typical high-throughput screen, sets of microtiter plates are generated, whereby each well in the microplate contains a different library member. For example, plates can be created where every well of a plate contains an antibody containing the same antibody heavy chain, but each well contains a different light chain such that the paired antibody (heavy and light chain) in each well is different from the antibody in all other wells of the plate. All wells are then loaded with the constant components necessary for performing the screening assay (for example, target protein or cell expressing a target protein, buffer, assay reagent), incubated for the appropriate time, and assayed for a readout of choice. This method can be used for screening for activities such as binding or other functional assays where reaction with a single purified target molecule or cell(s) is sufficient to give a readout.

For example, in such methods, a cell-based assay can be performed to effect activation of the target (e.g. in the presence of a ligand thereof) and activation (such as by assessing signaling, differentiation, proliferation, chemotaxis, apoptosis or other downstream process) is assessed in the presence of the antibody. Generally, the performance of such functional assays require the presence of soluble protein. Hence, it is an advantage of the antibody libraries provided herein that they permit screening in a soluble format. For example, the antibodies can be addressed, for example, in wells of a multiwall plate. Each antibody at each locus is different. Thus, upon assessing activity the identity of a "Hit" can be immediately determined.

Following an initial round of screening, identified "HITS" can be further optimized by iterative screening and/or by directed evolution methods. For example, following identification of a "Hit" 'focused' libraries can be created using information gained from the primary screening libraries. Focused libraries represent substructures of the original primary library because they are created from germline segment components that are related to those of the "Hit." They can allow one to refine the properties of a selected "Hit", such as by increasing its affinity of binding or associated functional activity.

The identity of the antibody is known by virtue of its address. Once identified, the antibody Hits can be generated as a full-length IgG or as Fab, Fab, Fab-SH and F(ab)$_2$ fragments. The antibody or fragments thereof can be created by traditional means, such as using recombinant techniques and enzymatic digestion. Antibodies or fragments thereof can be chimeric or humanized. The antibodies or fragments thereof can be used for diagnostic and therapeutic purposes as set forth below.

1. Binding Assays

The antibody libraries provided herein can be screened for their ability to bind a selected target by any method known to one of skill in the art. Exemplary target antigens are described below. Binding assays can be performed in solution, suspension or on a solid support. For example, target antigens can be immobilized to a solid support (e.g. a carbon or plastic surface or chip) and contacted with antibody. Unbound antibody or target protein can be washed away and bound complexes can then be detected. Binding assays can be performed under conditions to reduce nonspecific binding, such as by using a high ionic strength buffer (e.g. 0.3-0.4 M NaCl) with nonionic detergent (e.g. 0.1% Triton X-100 or Tween 20) and/or blocking proteins (e.g. bovine serum albumin or gelatin). Negative controls also can be including in such assays as a measure of background binding. Binding affinities can be determined using Scatchard analysis (Munson et al., *Anal. Biochem.*, 107:220 (1980)), BIACore or other methods known to one of skill in the art.

Exemplary binding assays include, but are not limited to immunoassays such as competitive and non-competitive assay systems using techniques such as western blots, radioimmunoassays, ELISA (enzyme linked immunosorbent assay), "sandwich" immunoassays, Meso Scale Discovery (MSD, Gaithersburg, Md.), immunoprecipitation assays, ELISPOT, precipitin reactions, gel diffusion precipitin reactions, immunodiffusion assays, agglutination assays, complement-fixation assays, immunoradiometric assays, fluorescent immunoassays, and protein A immunoassays. Such assays are routine and well known in the art (see, e.g., Ausubel et al., eds, 1994, Current Protocols in Molecular Biology, Vol. 1, John Wiley & Sons, Inc., New York, which is incorporated by reference herein in its entirety). Other assay formats include liposome immunoassays (LIA), which use liposomes designed to bind specific molecules (e.g., antibodies) and release encapsulated reagents or markers. The released chemicals are then detected according to standard techniques (see Monroe et al., (1986) *Amer. Clin. Prod. Rev.* 5:34-41).

Generally, binding is detected using a detectable moiety or label (e.g. an enzyme, a radionuclide, a fluorescent probe, electrochemiluminescent label, or a color dye) typically attached to the target or, if desired, directly to the antibody members in the library. Alternatively, binding can be detected by a further third reagent that itself is labeled or detectable. For example, detection of an antibody bound to a target protein can be achieved using a labeled capture molecule in a sandwich assay format. Other proteins capable of specifically binding immunoglobulin constant regions, such as protein A or protein G also can be used as the label agent. These proteins exhibit a strong non-immunogenic reactivity with immunoglobulin constant regions from a variety of species (see, e.g., Kronval et al., (1973) *J. Immunol.* 111:1401-1406; Akerstrom et al., (1985) *J. Immunol.* 135:2589-2542). The detction agent can be modified with a detectable moiety, such as biotin, to which another molecule can specifically bind, such as streptavidin. A variety of detectable moieties are well known to those skilled in the art.

The choice of label or detectable group used in the assay is not critical, as long as it does not significantly interfere with the specific binding of the antibody used in the assay. Generally, the choice depends on sensitivity required, ease of conjugation with the compound, stability requirements, available instrumentation, and disposal provisions. One of skill in the art is familiar with labels and can identify a detectable label suitable for and compatible with the assay employed.

The detectable group can be any material having a detectable physical or chemical property. Such detectable labels have been well-developed in the field of immunoassays and, in general, most any label useful in such methods can be applied to the present invention. Thus, a label is any composition detectable by spectroscopic, photochemical, biochemical, immunochemical, electrical, optical or chemical means. Useful labels in the present invention include magnetic beads (e.g., DYNABEADS™), fluorescent dyes (e.g., fluorescein isothiocyanate, Texas red, rhodamine, and the like), radiolabels (e.g., 3H, 125I, 35S, 14C, or 32P), enzymes (e.g., horse radish peroxidase, alkaline phosphatase and others commonly used in an ELISA), chemiluminescent labels (luciferin and 2,3-dihydrophtahlazinediones, e.g., luminol), and colorimetric labels such as colloidal gold or colored glass or plastic beads (e.g., polystyrene, polypropylene, latex, etc.). For a review of various labeling or signal producing systems that can be used, see e.g. U.S. Pat. No. 4,391,904.

Means of detecting labels are well known to those of skill in the art. Thus, for example, where the label is a radioactive label, means for detection include a scintillation counter or photographic film as in autoradiography. Where the label is a fluorescent label, it can be detected by exciting the fluorochrome with the appropriate wavelength of light and detecting the resulting fluorescence. The fluorescence can be detected visually, by the use of electronic detectors such as charge coupled devices (CCDs) or photomultipliers and the like. Similarly, enzymatic labels can be detected by providing the appropriate substrates for the enzyme and detecting the resulting reaction product. Finally simple colorimetric labels can be detected simply by observing the color associated with the label.

Some assay formats do not require the use of labeled components. For instance, agglutination assays can be used to detect the presence of the target antibodies. In this case, antigen-coated particles are agglutinated by samples containing the target antibodies. In this format, none of the components need be labeled and the presence of the target antibody is detected by simple visual inspection.

Alternatively, the antibody libraries provided herein can be screened for their ability to bind to cells, using whole cell panning, with or without subtractive panning. Screening can be done against live cells or against intact, mildly fixed target cells. Methods for whole cell panning have been described previously (see e.g. Siegel et al. (1997) *J. Immunol. Methods* 206:73-85 incorporated herein by reference). Other techniques for screening which can be applied include fluorescent activated cell sorting (FACs).

For high-throughput screening, assays can be multiplexed. Thus, the binding affinities of antibodies to a number of different target proteins can be determined at once. In one example, different target proteins can be separately labeled with different detectable moieities. For example, different antigens can be coupled to color-coded beads (Schwenk et al. (2007) Mol. Cell. Prot., 6:125-132). In another example, multi-spot plates can be used that permit assay multiplexing by absorption of of up to 100 proteins in a locus of the plate (e.g. using Multi-Array or Multi-Spot plates from Meso Scale Discovery; MSD, Gaithersburg, Md.). In such an example, addressed antibody libraries provided herein can be screened by addition of a different antibody member to each well of a multi-spot plate. The assay readily permits the screening of thousands of antibodies at once against numerous target proteins. This is exemplified herein in Example 13.

In the methods of screening herein, the binding affinity of the antibodies is determined to identify or select antibodies that have high affinity for a target protein. Typically, antibodies are selected or identified that have a binding affinity that is or is about $10^{-6}$M, $10^{-7}$M, $10^{-8}$M, $10^{-9}$M, $10^{-10}$M, $10^{-11}$M, $10^{-12}$M or lower. Generally, antibodies are screened until antibodies are identified having nanomolar or sub-nanomolar binding affinity. A "Hit" identified in a first round of screening that does not have the desired binding affinity can be optimized by iterative screening and/or directed evolution methods and further screened for binding to a target antigen to identify an antibody that has a high binding affinity.

Any method known to one of skill in the art can be used to measure the binding affinity of an antibody. For example, the binding properties of an antibody can be assessed by performing a saturation binding assay, for example, a saturation ELISA, whereby binding to a target protein is assessed with increasing amounts of antibody. In such experiments, it is possible to assess whether the binding is dose-dependent and/or saturable. In addition, the binding affinity can be extrapolated from the 50% binding signal. Typically, apparent binding affinity is measured in terms of its association constant (Ka) or dissociation constant (Kd) and determined using Scatchard analysis (Munson et al., *Anal. Biochem.*, 107:220 (1980). For example, binding affinity to a target protein can be assessed in a competition binding assay in where increasing concentrations of unlabeled protein is added, such as by radioimmunoassay (RIA) or ELISA. Binding affinity also can be analyzed using BIAcore kinetic analysis. This involves analyzing the binding and dissociation of an antibody member from chips containing immobilized target proteins on their surface. The Biacore evaluation software generates the values of Ka and Kd by fitting the data to interaction models. It is understood that the binding affinity of an antibody can vary depending on the assay and conditions employed, although all assays for binding affinity provide a rough approximation. By performing various assays under various conditions it is possible to estimate the binding affinity of an antibody.

In addition, binding affinities can differ depending on the structure of an antibody. For example, generally a bivalent antibody, for example a bivalent F(ab')2 fragment or full-length IgG, has a better binding affinity then a monovalent Fab antibody. Hence, it is understood that where a Fab has a specified binding affinity for a particular target, it is excepted that the binding affinity is even greater for a full-lenth IgG that is bivalent.

2. Functional Activity

The antibody libraries provided herein can be screened for their ability to modulate the functional activity of a target by any method known to one of skill in the art. Assays can be designed to identify antibodies capable of binding and/or modulating cell surface receptors. Such antibodies can either be agonists, mimicking the normal effects of receptor binding, or antagonists, inhibiting the normal effects of receptor binding. Of particular interest is the identification of agents which bind to the receptors and modulate intracellular signalling.

In some example, such assays are cell-based assays. Generally, assays are performed using cell lines known to express the target of interest. Such cells are known to one of skill in the art. For example, one can consult the ATCC Catalog (atcc.org) to identify cell lines. Also, if a particular cell type is desired, the means for obtaining such cells, and/or their instantly available source is known to those in the art. An analysis of the scientific literature can readily reveal appropriate choice of cells expressing any desired target. Table 18 lists exemplary cells lines that express targets of interest that can be screened in functional activities herein against antibody libraries provided herein.

TABLE 18

| Cell lines expressing targets | | |
|---|---|---|
| Target | Cell Lines | References |
| GP IIb/IIIa | MEG-01 chronic myelogenous leukemia megakaryoblast cells (ATCC CRL-2021); UT-7 human leukemia cell ine | Ogura et al. Establishment of a novel human megakaryoblastic leukemia cell line, MEG- 01, with positive Philadelphia chromosome. Blood 66: 1384-1392, 1985; Komatsu et al. Establishment and Characterization of a Human Leukemic Cell Line with Megakaryocytic Features: Dependency on Granulocyte-Macrophage Colony-stimulating Factor, Interleukin 3, or Erythropoietin for Growth and Survival. Cancer Research 51: 341-348 (1991) |
| GM-CSF-R | VA-ES-BJ epitheloid sarcoma cells (ATCC CRL-2138); TF1-HaRas; TF1-vRaf; TF1-vSrc; HL-60 (ATCC CCL-240); U-937 (ATCC CRL-1593.2); ML-2 | Int J Oncol 1995; 7: 51-56; Ali Habib et al. A urokinase-activated recombinant diphtheria toxin targeting the granulocyte-macrophage colony-stimulating factor receptor is selectively cytotoxic to human acute myeloid leukemia blasts. Blood 104(7): 2143-2148 (2004); Kiser et al. Oncogene-dependent engraftment of human myeloid leukemia cells in immunosuppressed mice. Leukemia 15(5): 814-818(2001) |
| VEGFA | Human A673 rhabdomyosarcoma cells (ATCC CRL-1598); Breast carcinoma MDA-MB-435 cells (ATCC); Bovine adrenal cortex-derived capillary endothelial cells | Gerber et al. Complete inhibition of rhabdomyosarcoma xenograft growth and neovascularization requires blockade of both tumor and host vascular endothelial growth factor. Cancer Res. 60(22): 6253-8 (2000); Presta et al. Humanization of an anti-vascular endothelial growth factor monoclonal antibody for the therapy of solid tumors and other disorders. Cancer Research, 57(20): 4593-4599 (1997) |
| CD3 | Jurkat E6.1 Human leukemic T cell lymphoblast (Sigma Aldrich 88042803) | Buhler et al. A bispecific diabody directed against prostate-specific membrane antigen and CD3 induces T-cell mediated lysis of prostate cancer cells. Cancer Immunol Immunother. 57(1): 43-52 (2008) |
| EGFR | DiFi human colorectal carcinoma cells; A431 cells (ATCC CRL-1555); Caco-2 colorectal adenocarcinoma cells (ATCC HTB-37); HRT-18 colorectal adenocarcinoma cells (ATCC CCL-244); HT-29 colorectal adenocarcinoma cells (ATCC HTB-38) | Olive et al. Characterization of the DiFi rectal carcinoma cell line derived from a familial adenomatous polyposis patient. In Vitro Cell Dev Biol. 29A(3 Pt 1): 239-248 (1993); Wu et al. Apoptosis induced by an anti-epidermal growth factor receptor monoclonal antibody in a human colorectal carcinoma cell line and its delay by insulin. Clin. Invest. 95(4): 1897-1905 (1995) |
| EPO receptor | A2780 ovarian cancer cells; UT-7 human leukemia cell ine | Jeong et al. Characterization of erythropoietin receptor and erythropoietin expression and function in human ovarian cancer cells. Int J Cancer. 122(2): 274-280 (2008); Elliott et al. Activation of the Erythropoietin (EPO) Receptor by Bivalent Anti-EPO Receptor Antibodies. J Biol Chem. 271(40): 24691-24697 (1996) |

TABLE 18-continued

Cell lines expressing targets

| Target | Cell Lines | References |
|---|---|---|
| Her2/Neu receptor | BT-474 ductal carcinoma breast cancer cell (ATCC HTB-20); SK-BR-3 adenocarcinoma breast cancer cell (ATCC HTB-30); MDA-MB-453 metastatic carcinoma cell line (ATCC HTB-131) | Le et al. Roles of human epidermal growth factor receptor 2, c-jun NH2-terminal kinase, phosphoinositide 3-kinase, and p70 S6 kinase pathways in regulation of cyclin G2 expression in human breast cancer cells. Mol Cancer Ther. 6(11): 2843-2857 (2007) |
| cMet | H1993 lung adenocarcinoma cells (ATCC CRL-5909); H1838 lung adenocarcinoma cells (ATCC CRL-5899); SW 900 lung squamous cell carcinoma cells (ATCC HTB-59); H358 lung bronchioalveolar carcinoma cells (ATCC CRL-5807); SK-Lu-1 lung adenocarcinoma cells (ATCC HTB-57); H441 Non-small cell lung cancer cells (ATCC HTB-174) | Ma et al. Functional expression and mutations of c-Met and its therapeutic inhibition with SU11274 and small interfering RNA in non-small cell lung cancer. Cancer Res. 65(4): 1479-1488 (2005); Ma et al. A selective small molecule c-MET Inhibitor, PHA665752, cooperates with rapamycin. Clin Cancer Res 11(6): 2312-2319 (2005) |
| CD20 | Ramos Burkitt's lymphoma B cells (ATCC CRL-1596); Raji Burkitt's lymphoma B cells (ATCC CCL-86): Daudi Burkitt's lymphoma B cells (ATCC CCL-213); 2F7 Burkitt's lymphoma B cells | Jazirehi et al. Rituximab (anti-CD20) selectively modifies Bcl-xL and apoptosis protease activating factor-1 (Apaf-1) expression and sensitizes human non-Hodgkin's lymphoma B cell lines to paclitaxel-induced apoptosis. Mol Cancer Ther. 2(11): 1183-1193 (2003) |

In addition, cells lines expressing a target of interest can be generated by transient or stable transfection with an expression vector expressing a target of interest. Methods of transfection and expression are known to those of skill in the art (see e.g., Kaufman R. J. (1990) Methods in Enzymology 185:537-566; Kaufman et al. (1990) Methods in Enzymology 185:537-566). In addition, any primary cell or cell line can be assessed for expression of a particular target (e.g. cell surface marker). Cell surface markers can be assayed using fluorescently labeled antibodies and FACS. Suitable cell lines include A549 (lung), HeLa , Jurkat, BJAB, Colo205, H1299, MCF7, MDA-MB-231, PC3, HUMEC, HUVEC, and PrEC.

Any suitable functional effect can be measured, as described herein. For example, cellular morphology (e.g., cell volume, nuclear volume, cell perimeter, and nuclear perimeter), ligand binding, substrate binding, nuclease activity, apoptosis, chemotaxis or cell migrations, cell surface marker expression, cellular proliferation, GFP positivity and dye dilution assays (e.g., cell tracker assays with dyes that bind to cell membranes), DNA synthesis assays (e.g., 3H-thymidine and fluorescent DNA-binding dyes such as BrdU or Hoechst dye with FACS analysis) and nuclear foci assays, are all suitable assays to identify potential modulators using a cell based system. Other functional activities that can be measured include, but are not limited to, ligand binding, substrate binding, endonuclease and/or exonuclease activity, transcriptional changes to both known and uncharacterized genetic markers (e.g., northern blots), changes in cell metabolism, changes related to cellular proliferation, cell surface marker expression, DNA synthesis, marker and dye dilution assays (e.g., GFP and cell tracker assays), contact inhibition, tumor growth in nude mice, and others.

For example, antibodies or portions thereof in the libraries provided herein can be assessed for their modulation of one or more phenotypes of a cell known to express a target protein. Phenotypic assays, kits and reagents for their use are well known to those skilled in the art and are herein used to screen antibody libraries. Representative phenotypic assays, which can be purchased from any one of several commercial vendors, include those for determining cell viability, cytotoxicity, proliferation or cell survival (Molecular Probes, Eugene, Oreg.; PerkinElmer, Boston, Mass.), protein-based assays including enzymatic assays (Panvera, LLC, Madison, Wis.; BD Biosciences, Franklin Lakes, N.J.; Oncogene Research Products, San Diego, Calif.), cell regulation, signal transduction, inflammation, oxidative processes and apoptosis (Assay Designs Inc., Ann Arbor, Mich.), triglyceride accumulation (Sigma-Aldrich, St. Louis, Mo.), angiogenesis assays, tube formation assays, cytokine and hormone assays and metabolic assays (Chemicon International Inc., Temecula, Calif.; Amersham Biosciences, Piscataway, N.J.).

Cells determined to be appropriate for a particular phenotypic assay (i.e., A549, HeLa, Jurkat, BJAB, Colo205, H1299, MCF7, MDA-MB-231, PC3, HUMEC, HUVEC, and PrEC and any others known to express the target of interest) are treated with antibodies as well as control compounds. If necessary, a ligand for the receptor target is included so that activation of the receptor is effected. At the end of the treatment period, treated and untreated cells are analyzed by one or more methods specific for the assay to determine phenotypic outcomes and endpoints.

Phenotypic endpoints include changes in cell morphology over time or treatment dose as well as changes in levels of cellular components such as proteins, lipids, nucleic acids, hormones, saccharides or metals. Measurements of cellular status which include pH, stage of the cell cycle, intake or excretion of biological indicators by the cell, are also endpoints of interest.

The assays can be performed to assess the direct effects of an antibody on a target protein. For example, if the target protein is a cell surface receptor, an antibody can be added to assess whether the target protein directly modulates, such as by stimulation, the activity or function of the receptor. In such instances, the antibody is deemed an agonist antibody. In other examples, if the target protein is a cell surface receptor, the activity of the receptor can be stimulated in the presence of a ligand or other stimulating agent in the presence or absence of the antibody to determine if the antibody modulates (e.g. inhibits) the actions of the antibody. For example, the antibody can act by blocking the ability of the ligand to interact with the receptor and/or otherwise induce a negative stimulatory signal. In such instances, the antibody is deemed to be an antagonist of the receptor. Thus, the methods of screening herein by functional activity permits identification of agonist and antagonist antibodies.

a. Differentiation

Cellular differentiation can be analyzed using any assay that allows a detection of a physical, chemical or phenotypic change. Various assays are used to quantitatively determine cellular proliferation and activation in response to an external stimuli. Cell proliferation assays are used to quantitatively determine cellular proliferation by incorporating a reagent into the DNA of newly synthesized cells upon cell division. Such reagents include, but are not limited to $^3$H-thymidine, 5-bromo-2-deoxyuridine (BrdU) and fluorescent Hoechst dyes. Cell viability assays are used to determine the number of healthy cells in a sample by staining cells with a dye and measuring how many cells uptake the dye based on the fact that living cells will exclude the dye. Such dyes include but are not limited to 3-(4,5-dimethylthiazol-2-yl)-2,5-diphenyltetrazolium bromide (MTT), 2,3-Bis(2-methoxy-4-nitro-5-sulfophenyl)-2H-tetrazolium-5-carboxanilide inner salt (XTT), and 4-[3-(4-iodophenyl)-2-(4-nitrophenyl)-2H-5-tetrazolio]-1,3-benzene disulfonate (WST-1). Uptake of the reagent is measured either colorimetrically using a spectrophotometer or by measuring radiation with a scintillation counter. Details of these methods are well-known to one skilled in the art. For example, Example 12 exemplifies an MTT proliferation assay to assess cell proliferation.

Fluorescent dyes are commonly used for the detection of live cells and key functional activities in a variety of cell-based assays. There are several non-radioactive, fluorescence-based assays that are not dependent on cellular metabolism. The fluorescent dye binds nucleic acids and the fluorescence can then be measured quantitatively or qualitatively. Such dyes include, but are not limited to, propidium iodide and Hoechst 33342. The cell number can then be quantitated based on the fluorescence. DNA content can also be quantitated using the tools available in the imaging instruments. Details of these methods are well known to one skilled in the art.

The degree of invasiveness into Matrigel or some other extracellular matrix constituent can be used as an assay to identify antibodies that are capable of inhibiting abnormal cell proliferation and tumor growth. Tumor cells exhibit a good correlation between malignancy and invasiveness of cells into Matrigel or some other extracellular matrix constituent. In this assay, tumorigenic cells are typically used as host cells. Therefore, antibodies can be identified by measuring changes in the level of invasiveness between the host cells before and after the introduction of potential modulators.

Briefly, the level of invasion of host cells can be measured by using filters coated with Matrigel or some other extracellular matrix constituent. Penetration into the gel, or through to the distal side of the filter, is rated as invasiveness, and rated histologically by number of cells and distance moved, or by prelabeling the cells with 125I and counting the radioactivity on the distal side of the filter or bottom of the dish. (see, e.g., Freshney, Culture of Animal Cells a Manual of Basic Technique, 3rd ed., Wiley-Liss, New York (1994), herein incorporated by reference).

b. Alteration of Gene Expression

Detection of binding and/or modulation of a target by an antibody can be accomplished by detecting a biological response, such as, for example, measuring $Ca^{2+}$ ion flux, cAMP, IP3, PIP3 or transcription of reporter genes. Analysis of the genotype of the cell (measurement of the expression of one or more of the genes of the cell using a reporter gene assay) after treatment is also used as an indicator of the efficacy or potency of the antibody. Hallmark genes, or those genes suspected to be associated with a signal transduction pathway are measured in both treated and untreated cells.

Assays can be performed that measure the activation of a reporter gene. Suitable reporter genes include endogenous genes as well as exogenous genes that are introduced into a cell by any of the standard methods familiar to the skilled artisan, such as transfection, electroporation, lipofection and viral infection. For example, cells expressing a recombinant receptor can be transfected with a reporter gene (e.g., chloramphenicol acetyltransferase, firefly luciferase, bacterial luciferase, -galactosidase and alkaline phosphatase) operably linked to a response element. The cells are then incubated with antibodies and the expression of the reporter gene is compared to expression in control cells that do not express the recombinant receptor but that are essentially identical in other respects. A statistically significant change in reporter gene expression in the receptor-expressing cells is indicative of a test compound that interacts with the receptor. Furthermore, the protein of interest can be used as an indirect reporter via attachment to a second reporter such as red or green fluorescent protein (see, e.g., Mistili & Spector, (1997) *Nature Biotechnology* 15:961-964).

The reporter construct is typically transfected into a cell. After treatment with a potential modulator, the amount of reporter gene transcription, translation, or activity is measured according to standard techniques known to those of skill in the art. The use of a reporter gene assay using luciferase to measure activiation of STAT5 directly or by induction of cyclin-D promoter is exemplified in Example 12.

c. Cytotoxicity Activity

Antibodies can be screened for their ability to directly induce apoptosis or programmed cell death or to indirectly induce apoptosis by blocking growth factor receptors, thereby effectively arresting proliferation. Antibodies also bind complement, leading to direct cell toxicity, known as complement dependent cytotoxicity (CDC). Thus, assays can be performed to assess complement-dependent cytotoxicity.

A variety of assays to assess apoptosis are known to one of skill in the art. For example, apoptosis assays include those that assay for the activation of a caspase, which are enzymes involved in apoptosis. Caspase assays are based on teh measurement of zymogen processing to an active enzyme and proteolytic activity. A number of commercial kits and reagents are available to assess apoptosis based on caspase function including, but not limited to, PhiPhiLux (Oncolmmunin, Inc.), Caspase 3 activity assay (Roche Applied science), Homogenous Caspase assay (Roche Applied Science), Caspase-Glo Assays (Promega), Apo-ONE Homogeneous Caspase-3/7 Assay (Promega), CaspACE Assay System Colorimetric or Fluormetric (Promega), EnzChek Caspase-3 Assay Kit (Invitrogen), Imag-iT LIVE green Caspase-3 and 7 Detection Kit (Invitrogen), Active Caspase-3 Detection Kits (Stratagene), Caspase-mediated Apoptosis Products (BioVision) and CasPASE Apoptosis Assay Kit (Genotech).

Example 11 exemplifies a assaying for apoptosis using a caspase assay.

Assays for apoptosis include TUNEL and DNA fragmentation assays that measure the activation of nucleases and subsequent cleavage of DNA into 180 to 200 base pair increments. Such assays and kits are commercially available and include, but are not limited to, Apoptotic DNA Ladder Kit (Roche Applied Science), Cellular DNA Fragmentation ELISA (Roche Applied Science), Cell Death Detection ELISAPLUS (Roche Applied Science), In Situ Cell Death Detection Kit (Roche Applied Science), DeadEnd Fluorometirc or Colorimetric TUNEL System (Promega), APO-BrdU TUNEL Assay Kit (Invitrogen), and TUNEL Apoptosis Detection Kit (Upstate).

Other assays to assess apoptosis include, for example, cell permeability assays that evaluate the loss of membrane integrity. For example, to determine whether the antibody is able to induce cell death, loss of membrane integrity as evaluated by uptake of propidium iodide (PI), trypan blue, or 7-aminoactinomycin D (7AAD) can be assessed relative to untreated cells. In addition, commercial kits such as APOPercentage Assay (Biocolor Assays) can be used to measure apoptosis. Annexin V assays also can be employed. Annexin V binds to phosphatidylserine, which is normally found on the inner surface of the cytoplasmic membrane. During apoptosis, phosphatidylserine is translocated to the outer surface and can be detected by Annexin V. For example, standard binding assays using a fluorescent labeled Annexin V can be used (e.g. Annexin V, Alex Fluor 350 Conjugate from Invitrogen). Apoptosis also can be measured by assessing the presence of other markers of apoptosis, assessing protein cleavage, and/or by mitochondrial and ATP/ADP assays. Such assays are routine and known to one of skill in the art.

For example, apoptosis analysis can be used as an assay to identify functional antibodies using cell lines, such as RKO or HCT116, or other cells expressing a target protein of interest. The cells can be co-transfected with a construct containing a marker gene, such as a gene that encodes green fluorescent protein, or a cell tracker dye. The apoptotic change can be determined using methods known in the art, such as DAPI staining and TUNEL assay using fluorescent microscope. For TUNEL assay, commercially available kit can be used (e.g., Fluorescein FragEL DNA Fragmentation Detection Kit (Oncogene Research Products, Cat.#QIA39) and Tetramethylrhodamine-5-dUTP (Roche, Cat. #1534 378)). Cells contacted with an antibody can exhibit, e.g., an increased apoptosis compared to control.

Cell death in vitro can be determined in the absence of complement and immune effector cells to distinguish cell death induced by antibody dependent cellular cytotoxicity (ADCC) or complement dependent cytotoxicity (CDC). Thus, the assay for cell death can be performed using heat inactivated serum (i.e. in the absence of complement) and in the absence of immune effector cells.

3. Targets

In the screening methods provided herein, the antibodies are screened for any activity, such as binding or other functional activity, against a target. The activity can be an agonist or antagonist activity of the target. The screening assays can be designed based on any contemplated target. Exemplary of such targets include membrane-bound proteins, receptors and ligands thereof; ion channels; G-protein coupled receptors; novel epitopes; and non-protein antigens. Any activity can be assessed and is a function of the target of interest. One of skill in the art is familiar with the activities of various targets, and can choose a screening assay based on such known activities. Many of these activities for exemplary targets are exemplified herein below. Binding activity can be assessed for all targets.

Membrane-Bound Proteins, Receptors and Ligands Thereof

Exemplary targets are membrane-bound proteins, receptors and ligands thereof that can play important roles in, among other things, the formation, differentiation and maintenance of multicellular organisms. Identifying antibodies that interfere with these functions is contemplated. For example, the fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment. Thus, identification of antibodies against any one or more of such targets (receptor or ligand) can modulate a pathway important in a disease, thereby modulating the disease and ameliorating symptoms thereof.

Such membrane-bound proteins and cell receptors include, but are not limited to, cytokine receptors, receptor kinases, receptor phosphatases, receptors involved in cell-cell interactions, and cellular adhesin molecules like cadherins and integrins, and ligands of any such receptors. Exemplary of such targets include, membrane bound receptors, such as cell surface receptors, including, but not limited to, a VEGFR-1, VEGFR-2, VEGFR-3 (vascular endothelial growth factor receptors 1, 2, and 4), a epidermal growth factor receptor (EGFR), ErbB-2, ErbB-b3, IGF-R1, C-Met (also known as hepatocyte growth factor receptor; HGFR), DLL4, DDR1 (discoidin domain receptor), KIT (recetpr for c-kit), FGFR1, FGFR2, FGFR4 (fibroblast growth factor receptors 1, 2, and 4), RON (recepteur d'origine nantais; also known as macrophage stimulating 1 receptor), TEK (endothelial-specific receptor tyrosine kinase), TIE (tyrosine kinase with immunoglobulin and epimermal growth factor homology domains receptor), CSF1R (colngly stimulating factor 1 receptor), PDGFRB (platelet-derived growth factor receptor B), EPHA1, EPHA2, EPHB1 (erythropoietin-producing hepatocellular receptor A1, A2 and B1), TNF-R1, TNF-R2, HVEM, LT-R, CD20, CD3, CD25, NOTCH, G-CSF-R, GM-CSF-R and EPO-R. Other targets include membrane-bound proteins such as selected from among a cadherin, integrin, CD52 or CD44. Exemplary ligands that can be targets of the screening methods herein, include, but are not limited to, VEGF-A, VEGF-B, VEGF-C, VEGF-D, PlGF, EGF, HGF, TNF-, LIGHT, BTLA, lymphotoxin (LT), IgE, G-CSF, GM-CSF and EPO.

One of skill in the art is familiar with the activity and functions of various target proteins. Thus, screening assays (e.g. binding or functional assays), such as any described above, for example, binding, proliferation or apoptosis assays, can be chosen to screen antibody libraries herein. Table 18A provides a summary of the activities and known function of exemplary target proteins, and exemplary assays that can be employed to screen such target proteins. In another example, antibodies or fragments thereof can be screened for binding affinity for a target protein. Binding can be to a known epitope in a target protein or to a novel epitope, which can be identified as described herein below. Table 18B provides examples of known epitopes for exemplary target proteins recognized by therapeutic antibodies. The sections that follow also further exemplify the activity and function of target proteins, including exemplary screening assays and antibodies identified thereby. It is understood that similar assays can be employed against any target protein of interest to identify antibodies that exhibit high affinity to the target protein and/or otherwise modulate the activity of a target protein.

TABLE 18A

TARGET PROTEINS

| Target | SEQ ID NO | Screening Assay | Functions/Activity | Existing Antibody Drugs |
|---|---|---|---|---|
| CD20 | 2011 | Apoptosis of B cell lymphoma cell lines expressing CD20 on the surface | B-cell lymphoma | Rituxan |
| HER2/Neu receptor | 1999 | Binding to HER2/Neu receptor and inhibition of cancer cell growth | Breast cancer | Herceptin |
| VEGFA | 2012 | Binding | Colorectal cancer, non-small lung cancer. Neovascular age-related macular degeneration | Avastin, Lucentis |
| EGFR | 2000 | Binding | Colorectal, head and neck, metastatic cancers | Erbitux, Vectibix |
| CD52 | 2013 | Binding to CD52 on T and B cells | B-cell chronic lymphocytic leukemia | Campath |
| TNFα | 2014 | Binding to TNFα blocks its interaction with p55 and p75 receptors, reducing the level of inflammation markers, CRP, ESR, IL6 | Rheumatoid arthritis | Humira, Remicade |
| CD25 | 2015 | Binding to CD25 (IL2 receptor) inhibits lymphocyte activation | Prophylaxis against allograft rejection | Simulect, Zenapax |
| CD3 | 2016 (delta) 2017 (gamma) 2018 (zeta) 2019 (epsilon) | Binding blocks T cell function | Allograft rejection, acute renal and hepatic | Orthoclone |
| IgE | 2020 (constant) 2021 (FcER1) 2022 (FcERII) | Binding to high affinity IgE reduces activation of mast cells, basophils and release of inflammatory mediators | Asthma | Xolair |
| IIb/IIIa integrin receptor | 2023 (IIIa) 2024 (IIb) | Binding to the receptor inhibits platelet aggregation | Prevention of cardiac ischaemia | ReoPro |
| EPO-R | 2009 | EPO binding activates STAT and stimulates erythropoiesis | Anaemia | Epogen |
| G-CSF receptor | 2025 | G-CSF binding stimulates neutrophill proliferation | Neutropaenia | Neupogen, Neulasta |
| GM-CSF receptor | 2026 | GM-CSF binding stiumulates proliferation and differentiation of neutrophils, eosinophils and monocytes | Leukopaenia | Lukine |

TABLE 18B

Epitopes

| TARGET | ANTIBODY | AMINO ACID SEQUENCE | SEQ ID NO |
|---|---|---|---|
| DLL4 | YW26.82 | ECIPHNGCRHGTCSTPWQCTCDEGWGGLFCD (252-282) | 2029 |
| EpoR | Mab 71 and Mab 73 | PGNYSFSYQLEDEPWKLCRLHQAPTARGAV (49-78) | 2030 |
| ErbB2 | 7C2 and 7F3 | STQVCTGTDMKLRLPASPETHLDMLRHLYQGC (22-53) | 2031 |
| | 4D5 | LPCHPECQPQNGSVTCFGPEADQCVACAHYKDPPFCVA RCPSGVKPDLSYMPIWKFPDEEGACQP (561-625) | 2032 |
| | 3H4 | VEECRVLQGLPREYVNARHCLPCHPECQPQNGSVTCFG PEADQCVACAHYKDPPFCVAR (541-599) | 2033 |
| Her2/Neu | Herceptin | PEADQ(557-561) + DPPF(570-573) + KFPDEEGACQP(593-603) | 2034 |
| | C24 (Pertuzumab) | Q156 + H245 + YF(252, 257) + T268 + DVGSCTPLH(285-290, 294-296) + K311 | 2035 |
| EGFR | IMC-C225 (Erbitux) | R353 + Q384 + QHFVS(408-409, 412, 417-418) + ISK(438, 440, 443) + KIISN(465-468, 473) | 2036 |
| | EGFR antibody [1i8k] | KK(293-294) + G + NYVVTD(298-303) | 2037 |

TABLE 18B-continued

Epitopes

| TARGET | ANTIBODY | AMINO ACID SEQUENCE | SEQ ID NO |
|---|---|---|---|
| VEGFA | Fab12 (Avastin) | [fy(17, 21)] + [yk(45, 48) + qiMRIkhqGQhiGEM(79-84, 86-94)] | 2038 |
| | G6 | [FMYQY(17, 18, 21, 22, 25) + Del(63, 64, 66) + cp(104, 106)] + [k48 + mIHqgQhI(81, 83, 86-91)] | 2039 |
| | B20-4 | [kFMDYqRYCH(16-19, 21-23, 25-27) + cndl(61-63, 66) + nkec(100, 101, 103, 104)] + [e30 + k48 + qmiQi(79, 81, 83, 89, 91)] | 2040 |
| | Fab 12 variant Y0317 | Y(71) + K(74) + QIMRIK(105-110) + HQGQHIGEM(112-120) + F(43) + Y(47) | 2041 |
| | Fab 12 variant Y0317 | F(43) + Y(47) + Y(71) + K(74) + QIMRIK(105-110) + HQGQHIGEM(112-120) | 2042 |
| CD52 | Campath | G + TSSPSA(32-37) + D | 2043 |
| CD20 | C2h7 | EPANPSEK 168-175 | 2044 |
| | C2b8 (Rituxan) | I(164) + NCEPANPSE(166-174) | 2045 |
| | C2b8 (Rituxan) | IYNCEPANP(164-172) + K(175) | 2046 |
| CD40 | 5c8 | EASS(129-132) + EKGYY(142-146) + C178 + C218 + SQVSHG(245-250) | 2047 |
| CD41 (GPIIb) | 10E5 | RNVGSQ(77-82) + N149 + N158 + SRLWH(206, 208, 213-215) | 2048 |
| TPO | TN1 | ETKAQ(57-61) + RGALQSLLGTQLPPQ(98, 102-115) | 2049 | i. Notch and Notch Ligands a) Notch Proteins

The Notch proteins (Notch1, set forth in SEQ ID NO:2002; Notch 2, set forth in SEQ ID NO:2003; Notch 3, set forth in SEQ ID NO: 2004; and Notch 4 set forth in SEQ ID NO:2005) are single-pass transmembrane receptor proteins that play a crucial role in cell-to-cell communication. Cell surface receptors in the Notch family are expressed on numerous types of cells, including many types of stem cells and undifferentiated progenitor cells, either in the embryo or in self-renewing tissues after birth, see e.g. Artavanis-Tsakonas, et al., (1995) Science 268:225-32. For example, human primary macophages express all Notch receptors, with Notch 3 being selectively increased during macrophage differentiation (see e.g., Fung et al. (2007) Circulation, 115: 2948-2956). Notch 4 also is expressed specifically in endothelial cells and plays a role in angiogenesis. Notch also is expressed on lymphocytes where Notch signaling participates in lymphocyte development, maturation, activation and transformation.

There are five Notch ligands, designated Delta Like-1 (DLL-1), Delta Like-3 (DLL-3), Delta Like-4 (DLL-4), Jagged-1 and Jagged-2. When Notch is activated by a ligand, its intracellular domain is proteolytically cleaved and transported to the nucleus, along with CSL (CBF-1/Su(H)/Lag-1/RBP-JK) transcription factor to activate transcription of downstream effectors. The resulting effector can repress the transcriptional activity of other genes encoding transcription factors for entry into terminal differentiation.

The Notch Signaling Pathway (NSP) is involved in many cellular processes, such as differentiation, cell fate decisions, maintenance of stem cells, cell motility, proliferation, and apoptosis in various cell types during development and tissue homeostasis. Notch signalling is dysregulated in many cancers, and faulty Notch signalling is implicated in many diseases including T-ALL (T-cell acute lymphoblastic leukemia), CADASIL, (Cerebral Autosomal Dominant Arteriopathy with Sub-cortical Infarcts and Leukoencephalopathy), Multiple Sclerosis (MS), Tetralogy of Fallot, Alagille Syndrome, multiple myeloma and other disease states thereby making Notch an important target in protein therapeuics (see e.g. U.S. Pat. No. 6,083,904).

Antibody libraries provided herein can be screened for modulation of an acitivity by assaying for binding to a Notch receptor and/or assaying for a functional activity, for example, proliferation, cell motility or apoptosis of cells known to express a Notch receptor. Example 13 exemplifies a binding assay to screen antibody libraries provided herein to select or identify antibodies that bind to Notch-1. Assays also include signal transduction assays such as by using an RBP-J/CBF-1 luciferase reporter assay (Fung et al. (2007) Circulation, 115: 2948-2956.) Assays can be performed in the presence or absence of a Notch ligand, for example, by coincubation of cells that express DLL4 (see e.g., Fung et al. (2007) Circulation, 115: 2948-2956) or by immobilization of a ligand (see e.g., Lefort et al. (2003) Experimental Hematology, 34:1720-1729). For example, as described in Fung et al., cells can be stably transfected with a construct expressing DLL4, and can be overlaid on human primary macrophages that express Notch and assayed in the presence of antibody library members.

The antibodies or portions thereof identified from the libraries provided herein that modulate an activity of a Notch receptor (Notch 1, Notch 2, Notch 3 and/or Notch 4) can be used for the treatment or prevention of a disease associated with expression and/or activity of Notch. The antibodies can be used as agonist antibodies or antagonist antibodies in such treatments. For example, agonist antibodies to Notch can be used to inhibit or decrease cancer cell growth or proliferation, such as in the treatment of various cancers including, but not limited to, prostate disorders and leukemia (see e.g., U.S. Pat. No. 6,689,744).

Antagonist antibodies provided herein also can be used in the treatment of a T-cell acute lymphoblastic leukemia; lymphoma; liver disease involving aberrant bascularization; diabetes; ovarian cancer; diseases involving vascular cell fate; rheumatoid arthritis; pancreatic cancer; non-small cell lung carcinoma; plasma cell neoplasmas such as multiple myeloma, plasma cell leukemia and extramedullary plasmacytoma; and neuroblastoma; and in treatment of plasma cell disorders such as multiple myeloma; angiogenesis; cancers such as sarcomas and carcinomas including but not limited to, breast cancer, colorectal cancer, lung cancer, pancreatic cancer, prostate cancer, liver cancer, ovarian cancer, head and neck cancer, skin cancer, brain cancer or blood cancer (see e.g., US20080226621, WO2008/091641, WO2005/054434). Notch signaling is associated in the development of skin, blood vessels and fat, and activated receptor can transform mammary epithelium. Hence, antagonist antibodies to Notch can be used in the treatment of breast tumors (see e.g. US20080206753).

Provided herein are antibodies that modulate the activity of Notch-1 and therefore can be used in the treatment of diseases or conditions associated with expression or activity of Notch-1. Such antibodies include those that have a VH chain and a VL chain encoded by a sequence of nucleotides compiled from germline segments, or any antibodies optimized therefrom. Exemplary of such antibodies are Fab antibodies. The antibodies further can contain a constant region. The antibodies include those that have a binding affinity for Notch-1 that is or is about $10^{-6}$M, $10^{-7}$M, $10^{-8}$M, $10^{-9}$M, $10^{-10}$M, $10^{-11}$M, $10^{12}$M, or lower, in particular any that have a nanomolar or sub-nanomolar binding affinity.

Anti-Notch-1 antibodies provided herein include antibodies having at least one CDR that is a CDRH1, CDRH2, CDRH3, CDRL1, CDRL2 and/or CDRL3. For example, a CDRH1 is GYTFTSYYMH (amino acids 26-35 of SEQ ID NO:1512); a CDRH2 is IINPSGGSTSYAQKFQG (amino acids 50-66 of SEQ ID NO:1512); a CDRH3 is EGYSSSWYDYFDY (amino acids 99-111 of SEQ ID NO:1512); a CDRH3 is EYYYGSGSYYNDYFDY (amino acids 99-114 of SEQ ID NO:1509); a CDRL1 is RASQSVSSNLA (amino acids 24-34 of SEQ ID NO:1843); a CDRL1 is RASQSVSSSYLA (amino acids 24-35 of SEQ ID NO:1833); a CDRL1 is RASQSISSWLA (amino acids 24-34 of SEQ ID NO:1841); a CDRL2 is GASTRAT (amino acids 50-56 of SEQ ID NO:1843); a CDRL2 is GASSRAT (amino acids 51-57 of SEQ ID NO:1833); a CDRL2 is DASSLES (amino acids 50-56 of SEQ ID NO:1841); a CDRL3 is QQYNNWPPWT (amino acids 8-98 of SEQ ID NO:1843); a CDRL3 is QQYGSSPPWT (amino acids 90-99 of SEQ ID NO:1833); and a CDRL3 is QQYNSYSPWT (amino acids 89-98 of SEQ ID NO:1841). Also provided herein is a CDR that exhibits 60%, 65%, 70%, 80%, 90%, 91%, 92%, 93%, 94%, 95%, 96%, 97%, 98%, 99% or more sequence identity to any of the above CDRs.

For example, antibodies that modulate an activity of Notch-1 include any that contain a VH chain encoded by a sequence of nucleotides containing germline components compiled from a $V_H$ germline segment that is an IGHV1 (e.g. any set forth in any of SEQ ID NOS:1-43); a $D_H$ germline segment that is an IGHD6 (e.g. any set forth in SEQ ID NOS: 268-271) or an IGHD3 (e.g. any set forth in SEQ ID NOS: 252-259); and a $J_H$ germline segment that is an IGHJ4 (e.g. set forth in SEQ ID NO: 278 or 279). Such antibodies also include any that contain a VL chain encoded by a sequence of nucleotides containing germline components compiled from a V germline segment that is an IGKV1 (set forth in any of SEQ ID NOS: 286-316) or an IGKV3 (e.g. any set forth in any of SEQ ID NOS:332-350); and a J germline segment that is an IGKJ1 (e.g. set forth in SEQ ID NO: 356). Such antibodies also include any that are encoded by a sequence of nucleotides containing germline segments that are variants of any of the above germline segments, for example due to conservative mutations or other mutations, so long as the resulting antibody is a functional and productive antibody and binds to Notch-1 and/or modulates a functional activity.

Exemplary of antibodies against Notch-1 include an antibody where the VH chain is encoded by a sequence of nucleotides compiled from a $V_H$ germline segment that is a IGHV1-46 (e.g. an IGHV1-46*01, IGHV1-46*02, or an IGHV1-46*03); a $D_H$ germline segment that is an IGHD3-10 (e.g. IGHD3-10*01, IGHD3-10*02) or an IGHD6-13 (e.g. IGHD6-13*01); and a JH germline segment that is an IGHJ4 (e.g. IGHJ4*01, IGHJ4*02, IGHJ4*03). The VL chain is encoded by a sequence of nucleotides compiled from a V germline segment that is an IGKV3-15 (e.g. IGKV3-15*01), IGKV3-20 (e.g. IGKV3-20*01, IGKV3-20*02) or an IGKV1-5 (e.g. IGKV1-5*01, IGKV1-5*02, IGKV1-5*03); and a J germline segment that is a IGKJ1*01. Exemplary antibodies provided herein that modulate an activity of Notch-1 are set forth in Table 18C.

TABLE 18C

Anti-Notch-1 Antibodies

| Heavy Chain Germline Segments | SEQ ID NO nucleotide | SEQ ID NO Amino acid | Light Chain Germline Segments | SEQ ID NO nucleotide | SEQ ID NO Amino acid |
|---|---|---|---|---|---|
| IGHV1-46*01; IGHD6-13*01; IGHJ4*01 | 1096 | 1512 | IGKV3-15*01; IGKJ1*01 | 1427 | 1843 |
| IGHV1-46*01; IGHD6-13*01; IGHJ4*01 | 1096 | 1512 | IGKV3-20*01; IGKJ1*01 | 1417 | 1833 |
| IGHV1-46*01; IGHD3-10*01; IGHJ4*01 | 1093 | 1509 | IGKV1-5*01; IGKJ1*01 | 1425 | 1841 | b) DLL4

DLL4 (set forth in SEQ ID NO:2010) is a transmembrane protein ligand for Notch transmembrane receptors. It is expressed widely in a variety of tissues, but its expression is predominantly localized to the vasculature. DLL4 activates Notch-1 and Notch-4 receptors. It is required for normal vascular development and is expressed on tumor vessels. It is upregulated in blood vessels during tumor angiogenesis and expression is dependent on VEGF signaling. DLL4 expression on angiogenic endothelial cells acts as a negative regulator of vascular growth by acting to allow angiogenesis to productively proceed (Ridgway et al. (2006) Nature, 444: 1083; Noguera-Troise et al. (2006) Nature, 444:1032). It acts to inhibit endothelial cell proliferation. Blockage of DLL4, however, is associated with increased angiogenesis characterized by sprouting and branching of blood vessels, but a decrease in vessel function, thereby resulting in decreased tumor growth (Ridgway et al. (2006) Nature, 444:1083; Noguera-Troise et al. (2006) Nature, 444:1032). Thus, DLL4 function is associated with an uncoupling of tumor growth from tumor vascular density. DLL4 also is expressed on activated macrophages exposed to proinflammatory stimuli such as lipopolysaccharide, interleukin-1, Toll-like receptor 4 ligands and other proinflammatory stimuli and it's signaling through the Notch pathway plays a role in inflammatory states characterized by macrophage activation (Fung et al. (2007) Circulation, 115: 2948-2956).

Antibody libraries provided herein can be screened for modulation of an acitivity by assaying for binding to DLL4 and/or assaying for a functional activity. Example 13 exemplifies a binding assay to screen antibody libraries provided herein to select or identify antibodies that bind to DLL4. Assays also include binding assays to assess the inhibition of DLL4-Notch interaction in the presence of an anti-DLL4 antibody. Such assays can be used to identify anagonist antibodies. This is exemplified in Example 17. Assays for functional activity include those that assess activation of Notch signaling by DLL4 by assaying for signal transduction and/or down stream functional activities such as are described above. Activiation of Notch can be achieved, for example, by coincubation with cells that express DLL4 and/or immobilization of DLL4, and assays performed in the presence of antibody members. In such assays, for example, the effects of antibodies on endothelial cell proliferation (e.g. HUVECs) induced by DLL4 can be assessed (see e.g., Ridgway et al. (2006) Nature, 444:1083). In some examples, antibodies can be used to assess effects on cell differentiation of a cell expressing Notch. The cells can be co-cultured with cells expressing a ligand for Notch, for example, DLL4 or Jag1. To identify antibodies that promote differentiation (i.e. interfere with Notch activation), antibodies can be added to the assay. An exemplary assay is set forth in Example 18.

Hence, the antibodies identified from the libraries provided herein or the antibodies provided herein bind (such as specifically bind) DLL4, and in some embodiments, can modulate one or more aspects of DLL4-associated effects, including but not limited to any one or more of reduction or blocking of Notch receptor activation, reduction or blocking of Notch receptor downstream molecular signaling, disruption or blocking of Notch receptor binding to DLL4, and/or promotion of endothelial cell proliferation, and/or inhibition of endothelial cell differentiation, and/or inhibition of arterial differentiation, and/or inhibition of tumor vascular perfusion, and/or treatment and/or prevention of a tumor, cell proliferative disorder or a cancer; and/or treatment or prevention of a disorder associated with DLL4 expression and/or activity and/or treatment or prevention of a disorder associated with Notch receptor expression and/or activity. In some embodiments, the antibody specifically binds to DLL4. In some embodiments, the antibody specifically binds to the DLL4 extracellular domain (ECD). In some embodiments, an antibody reduces, inhibits, and/or blocks DLL4 activity in vivo and/or in vitro. In some embodiments, the antibody competes for binding with DLL4-ligand (reduces and/or blocks Notch receptor binding to DLL4).

The antibodies or portions thereof identified from the libraries provided herein that modulate an activity of DLL4 can be used for the treatment or prevention of disease states associated with expression and/or activity of DLL4, such as increased expression and/or activity or undesired expression and/or activity (see e.g., U.S. Published Application Serial No. US20080175847 and International Published PCT Appl. No. WO2008060705, WO2008091222). Treatment includes neoplastic and non-neoplastic disorders. For example, the antibodies or portions thereof can be used to treat a tumor, a cancer (e.g. colon cancer, lung cancer or breast cancer) and/or a cell proliferative disorder and/or conditions associated with angiogenesis (e.g. intraocular neovascular disease). In particular, the antibodies or portions thereof can be used in combination with anti-VEGF therapies and/or in treatments that are resistant to anti-VEGF treatment.

Angiogenesis is implicated in the pathogenesis of a variety of disorders. These include solid tumors and metastasis, atherosclerosis, retrolental fibroplasia, hemangiomas, chronic inflammation, intraocular neovascular diseases such as proliferative retinopathies, e.g., diabetic retinopathy, age-related macular degeneration (AMD), neovascular glaucoma, immune rejection of transplanted corneal tissue and other tissues, rheumatoid arthritis, and psoriasis. Folkman et al., *J. Biol. Chem.* 267:10931-34 (1992); Klagsbrun et al., *Annu. Rev. Physiol.* 53:217-39 (1991); and Garner A., "Vascular diseases," In: Pathobiology of Ocular Disease. A Dynamic Approach, Garner A., Klintworth G K, eds., 2nd Edition (Marcel Dekker, NY, 1994), pp 1625-1710.

In the case of tumor growth, angiogenesis appears to be crucial for the transition from hyperplasia to neoplasia, and for providing nourishment for the growth and metastasis of the tumor. Folkman et al., *Nature* 339:58 (1989). The neovascularization allows the tumor cells to acquire a growth advantage and proliferative autonomy compared to the normal cells. A tumor usually begins as a single aberrant cell which can proliferate only to a size of a few cubic millimeters due to the distance from available capillary beds, and it can stay 'dormant' without further growth and dissemination for a long period of time. Some tumor cells then switch to the angiogenic phenotype to activate endothelial cells, which proliferate and mature into new capillary blood vessels. These newly formed blood vessels not only allow for continued growth of the primary tumor, but also for the dissemination and recolonization of metastatic tumor cells. Accordingly, a correlation has been observed between density of microvessels in tumor sections and patient survival in breast cancer as well as in several other tumors. Weidner et al., *N. Engl. J. Med.* 324:1-6 (1991); Horak et al., *Lancet* 340:1120-24 (1992); Macchiarini et al., *Lancet* 340:145-46 (1992). The precise mechanisms that control the angiogenic switch is not well understood, but it is believed that neovascularization of tumor mass results from the net balance of a multitude of angiogenesis stimulators and inhibitors (Folkman, *Nat. Med.* 1(1):27-31 (1995)).

In addition, antibodies or portions thereof can be used to treat non-neoplastic disorders including, but not limited to, undesired or aberrant hypertrophy, arthritis, rheumatoid arthritis (RA), psoriasis, psoriatic plaques, sarcoidosis, atherosclerosis, atherosclerotic plaques, edema from myocardial infarction, diabetic and other proliferative retinopathies including retinopathy of prematurity, retrolental fibroplasia, neovascular glaucoma, age-related macular degeneration, diabetic macular edema, corneal neovascularization, corneal graft neovascularization, corneal graft rejection, retinal/choroidal neovascularization, neovascularization of the angle (rubeosis), ocular neovascular disease, vascular restenosis, arteriovenous malformations (AVM), meningioma, hemangioma, angiofibroma, thyroid hyperplasias (including Grave's disease), corneal and other tissue transplantation, chronic inflammation, lung inflammation, acute lung injury/ARDS, sepsis, primary pulmonary hypertension, malignant pulmonary effusions, cerebral edema (e.g., associated with acute stroke/closed head injury/trauma), synovial inflammation, pannus formation in RA, myositis ossificans, hypertropic bone formation, osteoarthritis (OA), refractory ascites, polycystic ovarian disease, endometriosis, 3rd spacing of fluid diseases (pancreatitis, compartment syndrome, burns, bowel disease), uterine fibroids, premature labor, chronic inflammation such as IBD (Crohn's disease and ulcerative colitis), renal allograft rejection, inflammatory bowel disease, nephrotic syndrome, undesired or aberrant tissue mass growth (non-cancer), obesity, adipose tissue mass growth, hemophilic joints, hypertrophic scars, inhibition of hair growth, Osier-Weber syndrome, pyogenic granuloma retrolental fibroplasias, scleroderma, trachoma, vascular adhesions, synovitis, dermatitis, preeclampsia, ascites, pericardial effusion (such as that associated with pericarditis), and pleural effusion.

Provided herein are antibodies that modulate the activity of DLL4 and therefore can be used in the treatment of diseases or conditions associated with expression or activity of DLL4. Such antibodies include those that have a VH chain and a VL chain encoded by a sequence of nucleotides compiled from germline segments, or any antibodies optimized therefrom. Exemplary of such antibodies are Fab antibodies. The antibodies further can contain a constant region. The antibodies include those that have a binding affinity for DLL4 that is or is about $10^{-6}$ M, $10^{-7}$ M, $10^{-8}$ M, $10^{-9}$ M, $10^{-10}$ M, $10^{-11}$ M, $10^{-12}$ M or lower, in particular any that have a nanomolar or sub-nanomolar binding affinity.

Anti-DLL4 antibodies provided herein include antibodies having at least one CDR that is a CDRH1, CDRH2, CDRH3, CDRL1, CDRL2 and/or CDRL3. For example, a CDRH1 is GYTFTSYYMH (amino acids 26-35 of SEQ ID NO:1513); a CDRH1 is GYSFTSYWIG (amino acids 26-35 of SEQ ID NO:1803); a CDRH1 is GDSVSSNSAAWN (amino acids 26-37 of SEQ ID NO:1812); a CDRH1 is GGSFSGYYWS (amino acids 26-35 of SEQ ID NO:1779); a CDRH1 is GYTFTSYAMH (amino acids 26-35 of SEQ ID NO:1494); a CDRH1 is GYTFTSYDIN (amino acids 26-35 of SEQ ID NO:1537); a CDRH1 is GGSISSGGYYWS (amino acids 26-37 of SEQ ID NO:1761); a CDRH2 is IINPSGGSTSYAQKFQG (amino acids 50-66 of SEQ ID NO:1513); a CDRH2 is IIYPGDSDTRYSPSFQG (amino acids 50-66 of SEQ ID NO:1803); a CDRH2 is RTYYRSKWYNDYAVSVKS (amino acids 52-69 of SEQ ID NO:1812); a CDRH2 is EINHSGSTNYNPSLKS (amino acids 50-65 of SEQ ID NO:1779); a CDRH2 is WSNAGNGNTKYSQEFQG (amino acids 50-66 of SEQ ID NO:1494); a CDRH2 is WMNPNSGNTGYAQKFQG (amino acids 50-66 of SEQ ID NO:1537); a CDRH2 is (amino acids 52-67 of SEQ ID NO:1761); a CDRH3 is EEYSSSSAEYKQH (amino acids 99-111 of SEQ ID NO:1513); a CDRH3 is RGYSYGYDYFDY (amino acids 99-110 of SEQ ID NO:1803); a CDRH3 is EYYDFWSGYYTDYFD (amino acids 102-117 of SEQ ID NO:1812); a CDRH3 is EGYSSSWYDYFDY (amino acids 99-111 of SEQ ID NO:1512); a CDRH3 is ANWGDYFDY (amino acids 89-106 of SEQ ID NO:1779); a CDRH3 is ANWGYWYFDL (amino acids 99-108 of SEQ ID NO:1514); a CDRH3 is DDYGGNSDYFDY (amino acids 99-110 of SEQ ID NO:1494); a CDRH3 is EGYCSGGSCYSYWYFDL (amino acids 99-115 of SEQ ID NO:1508); a CDRH3 is EYYYGSGSYYNDYFDY (amino acids 99-114 of SEQ ID NO:1509); a CDRH3 is GGYCSSTSCYADYYYYYGMDV (amino acids 99-119 of SEQ ID NO:1537); a CDRH3 is EGYCSGGSCYSYWYFDL (amino acids 100-116 of SEQ ID NO:1761); a CDRL1 is RASQSVSSYLA (amino acids 24-34 of SEQ ID NO:1850); a CDRL1 is GLSSGSVSTSYYPS (amino acids 23-36 of SEQ ID NO:1881); a CDRL1 is TLRSGINLGSYRIF (amino acids 23-36 of SEQ ID NO:1884); a CDRL1 is RASQSVSSNLA (amino acids 24-34 of SEQ ID NO:1843); a CDRL1 isRASQGISSWLA (amino acids 24-34 of SEQ ID NO:1849); a CDRL1 is RASQSVSSSYLA (amino acids 24-35 of SEQ ID NO:1833); a CDRL1 is RASQSISSWLA (amino acids 24-34 of SEQ ID NO:1841); a CDRL1 is RSSQSLLDSDDGNTYLD (amino acids 24-40 of SEQ ID NO:1853); a CDRL1 is TGTSSDVGGYNYVS (amino acids 23-36 of SEQ ID NO:1864); a CDRL1 is TLSSDLSVGGKNMF (amino acids 23-36 of SEQ ID NO:1886); a CDRL2 is DASNRAT (amino acids 50-56 of SEQ ID NO:1850); a CDRL2 is STNTRSS (amino acids 52-58 of SEQ ID NO:1881); a CDRL2 is YYSDSSK (amino acids 52-58 of SEQ ID NO:1884); a CDRL2 is GASTRAT (amino acids 50-56 of SEQ ID NO:1843); a CDRL2 is AASSLQS (amino acids 50-56 of SEQ ID NO:1849); a CDRL2 is GASSRAT (amino acids 51-57 of SEQ ID NO:1833); a CDRL2 is DASSLES (amino acids 50-56 of SEQ ID NO:1841); a CDRL2 is TLSYRAS (amino acids 56-62 of SEQ ID NO:1853); a CDRL2 is EVSNRPS (amino acids 52-58 of SEQ ID NO:1864); a CDRL2 is HYSDSDK (amino acids 52-58 of SEQ ID NO:1886); a CDRL3 is QQRSNWPPWT (amino acids 89-98 of SEQ ID NO:1850); a CDRL3 is VLYMGSGISYV (amino acids 91-101 of SEQ ID NO:1881); a CDRL3 is MIWHSSASFV (amino acids 97-106 of SEQ ID NO:1884); a CDRL3 is QQYNNWPPWT (amino acids 89-98 of SEQ ID NO:1843); a CDRL3 is QQANSFPPWT (amino acids 89-98 of SEQ ID NO:1849); a CDRL3 is QQYGSSPPWT (amino acids 90-99 of SEQ ID NO:1833); a CDRL3 is QQYNSYSPWT (amino acids 89-98 of SEQ ID NO:1841); a CDRL3 is MQRIEFPSWT (amino acids 95-104 of SEQ ID NO:1853); a CDRL3 is SSYTSSSTLFV (amino acids 91-101 of SEQ ID NO:1864); and a CDRL3 is QVYESSANFV (amino acids 89-98 of SEQ ID NO:1886). Also provided herein is a CDR that exhibits 60%, 65%, 70%, 80%, 90%, 91%, 92%, 93%, 94%, 95%, 96%, 97%, 98%, 99% or more sequence identity to any of the above CDRs.

For example, antibodies that modulate an activity of DLL4 include any that contain a VH chain encoded by a sequence of nucleotides containing germline components compiled from a $V_H$ germline segment that is an IGHV1 (e.g. any set forth in any of SEQ ID NOS:10-43), an IGHV4 (e.g. any set forth in SEQ ID NOS: 153-224), an IGHV5 (e.g. any set forth in SEQ ID NOS: 225-232) or an IGHV6 (e.g., any set forth in any of SEQ ID NOS: 233 or 234); a $D_H$ germline segment that is an IGHD6 (e.g. any set forth in SEQ ID NOS: 268-271), an IGHD5 (e.g. any set forth in any of SEQ ID NOS: 264-267); an IGHD4 (e.g. any set forth in SEQ ID NOS: 260-263); an IGHD2 (e.g. any set forth in SEQ ID NOS: 244-251), an IGHD3 (e.g. any set forth in any of SEQ ID NOS: 252-259) an IGHD6 (e.g. any set forth in SEQ ID NO: 268-271), or an IGHD7 (e.g. set forth in SEQ ID NO:272); and a $J_H$ germline segment that is an IGHJ1 (e.g., set forth in SEQ ID NO:273), an IGHJ2 (set forth in SEQ ID NO:274), an IGHJ4 (e.g. any set forth in any of SEQ ID NOS: 277-279), or an IGHJ6 (e.g. any set forth in SEQ ID NOS: 282-285). Such antibodies also include any that contain a VL chain encoded by a sequence of nucleotides containing germline components compiled from a V germline segment that is an IGKV1 (e.g. any set forth in any of SEQ ID NOS: 286-316), an IGKV2 (e.g. any set forth in SEQ ID NOS: 317-331), or an IGKV3 (e.g. any set forth in any of SEQ ID NOS:332-350) and a J germline segment that is an IGKJ1 (e.g. set forth in SEQ ID NO: 356); or from a V germline segment that is an IGLV2 (e.g. any set forth in any of SEQ ID NOS:380-399), IGLV8 (e.g. any set forth in any of SEQ ID NOS: 436-438), IGLV11 (e.g. any set forth in any of SEQ ID NO: 379), or a IGLV5 (e.g. any set forth in any of SEQ ID NOS: 424-431) and a J germline segment that is a IGLJ1 (e.g. set forth in SEQ ID NO:442) or an IGLJ4 (e.g. set forth in SEQ ID NO:446). Such antibodies also include any that are encoded by a sequence of nucleotides containing germline segments that are variants of any of the above germline segments, for example due to conservative mutations or other nucleotide mutations, so long as the resulting antibody is a functional and productive antibody and binds to DLL4 and/or modulates a functional activity.

Exemplary of antibodies against DLL4 include an antibody where the VH chain is encoded by a sequence of nucleotides compiled from a $V_H$ germline segment that is an IGHV1-3 (e.g. IGHV1-3*01, IGHV1-3*02), an IGHV1-8*01, an IGHV1-46 (e.g. an IGHV1-46*01, IGHV1-46*02 or an IGHV1-46*03), an IGHV4-31 (e.g. IGHV4-31*01, IGHV4-31*02, IGHV4-31*03, IGHV4-31*04, IGHV4-31*05, IGHV4-31*06, IGHV4-31*07, IGHV4-31*08, IGHV4-31*09, IGHV4-31*10), an IGHV4-34 (e.g. IGHV4-34*01, IGHV4-34*02, IGHV4-34*03, IGHV4-34*04, IGHV4-34*05, IGHV4-34*06, IGHV4-34*07, IGHV4-34*08, IGHV4-34*09, IGHV4-34*10, IGHV4-34*11, IGHV4-34*12, IGHV4-34*13), an IGHV5-51 (e.g., an IGHV1-5-51*01, IGHV1-5-51*02, IGHV1-5-51*03, IGHV1-5-51*04 or IGHV1-5-51*05) or is an IGHV6-1 (e.g. an IGHV6-1*01 or an IGHV6-1*02); a $D_H$ germline segment that is an IGHD2-2 (e.g. IGHD2-2*01, IGHD2-2*02), an IGHD2-15*01, an IGHD4-23*01, an IGHV6-6 (e.g. IGHD6-6*01), an IGHD6-13*01, an IGHD5-18 (e.g. an IGHD5-18*01), an IGHD3-3 (e.g. an IGHD3-3*01 or IGHD3-3*02), an IGHD3-10 (e.g. IGHD3-10*01, IGHD3-10*02), or an IGHD7-27*01; and a $J_H$ germline segment that is a IGHJ1*01, IGHJ2*01, IGHJ4*01, IGHJ4*02, IGHJ4*03, or an IGHJ6 (e.g. IGHJ6*01, IGHJ6*02, IGHJ6*03, IGHJ6*04). The VL chain is encoded by a sequence of nucleotides compiled from a V germline segment that is an IGKV1-5 (e.g. IGKV1-5*01, IGKV1-5*02, IGKV1-5*03), an IGKV1-12 (e.g IGKV1-12*01, IGKV1-12*02), an IGKV2-D-40*01, an IGKV3-11 (e.g. IGKV3-11*01 or IGKV3-11*02), an IGKV3-15*01, an IGKV3-20 (e.g. IGKV3-20*01, IGKV3-20*02) and a J germline segment that is a IGKJ1*01; or is compiled from a V germline segment that is an IGLV2-14 (e.g. IGLV2-14*01, IGLV2-14*02, IGLV2-14*03, IGLV2-14*04), an IGLV8-61 (e.g. IGLV8-61*01, IGLV8-61*02 or IGLV8-61*03), an IGLV5 (e.g. IGLV5-48*01), or an IGLV11-55*01 and a J germline segment that is a IGLJ1*01 or IGLJ4*01. Exemplary antibodies provided herein that modulate an activity of DLL4 are set forth in Table 18D.

TABLE 18D

Anti-DLL4 Antibodies

| Heavy Chain Germline Segments | SEQ ID NO nucleotide | SEQ ID NO Amino acid | Light Chain Germline Segments | SEQ ID NO nucleotide | SEQ ID NO Amino acid |
|---|---|---|---|---|---|
| IGHV1-46*01; IGHD6-6*01; IGHJ1*01 | 1097 | 1513 | IGKV3-11*01; IGKJ1*01 | 1434 | 1850 |
| IGHV5-51*03; IGHD5-18*01>3; IGHJ4*01 | 1387 | 1803 | IGLV8-61*01; IGLJ1*01 | 1465 | 1881 |
| IGHV6-1*01; IGHD3-3*01; IGHJ4*01 | 1396 | 1812 | IGLV5-48*01; IGLJ4*01 | 1468 | 1884 |
| IGHV1-46*01; IGHD6-13*01; IGHJ4*01 | 1096 | 1512 | IGKV3-15*01; IGKJ1*01 | 1427 | 1843 |
| IGHV4-34*01; IGHD7-27*01; IGHJ4*01 | 1363 | 1779 | IGKV1-12*01; IGKJ1*01 | 1433 | 1849 |
| IGHV1-46*01; IGHD6-13*01; IGHJ4*01 | 1096 | 1512 | IGKV3-20*01; IGKJ1*01 | 1417 | 1833 |
| IGHV1-3*02; IGHD4-23*01; IGHJ4*01 | 1078 | 1494 | IGKV1-5*01; IGKJ1*01 | 1425 | 1841 |
| IGHV1-46*01; IGHD2-15*01; IGHJ2*01 | 1092 | 1508 | IGKV1-5*01; IGKJ1*01 | 1425 | 1841 |
| IGHV1-46*01; IGHD3-10*01; IGHJ4*01 | 1093 | 1509 | IGKV1-5*01; IGKJ1*01 | 1425 | 1841 |
| IGHV1-8*01; IGHD2-2*01; IGHJ6*01 | 1121 | 1537 | IGKV1-5*01; IGKJ1*01 | 1425 | 1841 |
| IGHV1-46*01; IGHD6-13*01; IGHJ4*01 | 1096 | 1512 | IGKV2D-40*01; IGKJ1*01 | 1437 | 1853 |
| IGHV4-34*01; IGHD7-27*01; IGHJ4*01 | 1363 | 1779 | IGLV2-14*01; IGLJ4*01 | 1448 | 1864 |
| IGHV4-31*02; IGHD2-15*01; IGHJ2*01 | 1345 | 1761 | IGLV2-14*01; IGLJ4*01 | 1448 | 1864 |
| IGHV4-34*01; IGHD7-27*01; IGHJ4*01 | 1363 | 1779 | IGLV11-55*01; IGLJ4*01 | 1470 | 1886 |

Anti-DLL4 antibodies provided herein include antibodies that are optimized compared to any of the identified anti-DLL4 germline Hits. The antibodies include one or more mutations in the VH chain and/or one or more mutations in the VL chain compared to an identified germline Hit. For example, the antibodies can contain 1, 2, 3, 4, 5, 6, 7, 8, 9, 10, 11, 12, 13, 14, 15, 16, 17, 18, 19, 20 or more amino acid replacements compared to the corresponding antibody germline Hit. The mutations can be in the VH chain, for example, in any one or more of the amino acid residues of a $V_H$, $D_H$ or $J_H$ region. Alternatively, or in addition, the mutations can be in the VL chain, for example, in any one or more of the amino acid residues of the $V_L$ or $J_L$ region. Optimized antibodies containing one or more mutations exhibit improved activity compared to the parent antibody (e.g. germline Hit not containing the modifications). The antibodies are optimized to exhibit an improved functional activity, either agonistic or antagonistic, against the DLL4 target protein. In other examples, the antibodies are optimized to exhibit an improved binding affinity for DLL4. Generally, an activity or binding affinity is increased by at or about 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1000-fold or more compared to an activity or binding affininity of the parent antibody (e.g. germline Hit not containing the modification(s)). For example, as described in the Examples, optimized anti-DLL4 antibodies provided herein exhibit a binding affinity that is improved by at least 100-fold compared to the parent antibody. Such antibodies exhibit a nanomolar binding affinity.

For example, provided herein are optimized anti-DLL4 antibodies that contain one or more mutations in the VH chain of an anti-DLL4 Hit, for example, any set forth in any of SEQ ID NOS: 1494, 1508-1509, 1512-1513, 1537, 1761, 1779, 1803 and 1812. In one example, the one or more mutations include mutations in the $D_H$ region. For example, an anti-DLL4 antibody provided herein can include a VH chain containing a germline segment compiled from a variant of a IGHD5-18*01 that encodes a DH region that contains a mutation(s) at position G1 and/or G5 corresponding to amino acid residues set forth in SEQ ID NO:3736 (also corresponding to amino acid residues G100 and/or G104 set forth in the VH chain of the anti-DLL4 Hit set forth in SEQ ID NO: 1803). The mutation can be to any other amino acid residue, in particular, the mutation is a lysine (K), Arginine (R), threonine (T). Exemplary of such mutations are G1K, G1R, and/or G5T corresponding to amino acid replacements in the $D_H$ region set forth in SEQ ID NO:3736 (also corresponding to amino acid replacements G100K, G100R, and/or G104T in the VH chain of the anti-DLL4 Hit set forth in SEQ ID NO:1803). In another example, an anti-DLL4 antibody provided herein can include a VH chain containing germline segments compiled from a variant of IGHD6-6*01 that encodes a $D_H$ region that contains a mutations(s) at positions S3, S4 and/or S5 corresponding to amino acid residues set forth in SEQ ID NO:3737 (also corresponding to amino acid residues S102, S103 and/or S104 in the VH chain of the anti-DLL4 Hit set forth in SEQ ID NO: 1513. The mutation can be to any other amino acid residue, in particular, the mutation is a alanine (A), proline (P) or phenylalanine (F). Exemplary of such mutations are S3A, S4P, S5F and/or S5A corresponding to amino acid replacements in the $D_H$ region set forth in SEQ ID NO:3737 (also corresponding to amino acid replacements S102A, S103P, S104F and S104A in the VH chain of the anti-DLL4 Hit set forth in SEQ ID NO:1513. Table 18E lists exemplary anti-DLL4 antibody variants containing one or more mutations in the $D_H$ region of the VH chain of anti-DLL4 Hits.

Also provided herein are optimized anti-DLL4 antibodies containing one or more mutations in the $J_H$ region of the VH chain of an anti-DLL4 hit. For example, an anti-DLL4 antibody provided herein can include a VH chain containing a germline segment compiled from a variant of an IGHJ1*01 that encodes a $J_H$ region that contains a mutation at position H6 corresponding to amino acid residue set forth in SEQ ID NO:3738 (also corresponding to amino acid residue H111 in the VH chain of the anti-DLL4 Hit set forth in SEQ ID NO:1513). The mutation can be to any other amino acid residue, in particular, the mutation is a phenylalanine (F) or a tyrosine (Y). Exemplary of such mutations are H6F and H6Y corresponding to amino acid replacements in the $J_H$ region set forth in SEQ ID NO:3738 (also corresponding to amino acid replacements H111F and H111Y in the $J_H$ region of the VH chain of the anti-DLL4 Hit set forth in SEQ ID NO:1513). Table 18E lists exemplary anti-DLL4 antibody variants containing one or more mutations in the $J_H$ region of the VH chain of anti-DLL4 Hits.

Optimized anti-DLL4 antibodies provided herein also can contain one or more amino acid mutations in the VL chain. For example, provided herein are optimized anti-DLL4 antibodies containing one or more mutation in the V region of the VL chain of an anti-DLL4 hit. For example, an anti-DLL4 antibody provided herein can include a VL chain containing a germline segment compiled from a variant of an IGKV3-11 (e.g. IGKV3-11*01 or IGKV3-11*02) that encodes a V region that contains a mutation at position S28, S30 and/or S31 corresponding to amino acid residues set forth in SEQ ID NO:3739 (also corresponding to amino acid resdues S28, S30 and/or S31 in the VL chain of the anti-DLL4 Hit set forth in SEQ ID NO:1850). The mutation can be to any other amino acid residue, in particular, the mutation is a proline (P), asparagine (N), or lysine (K). Exemplary of such mutations are S28P, S30N and/or S31K corresponding to amino acid replacements in the V region set forth in SEQ ID NO:3739 (also corresponding to amino acid replacements S28P, S30N and/or S31K in the V region of the VL chain of the anti-DLL4 Hit set forth in SEQ ID NO:1850). Table 18E lists exemplary anti-DLL4 antibody variants containing one or more mutations in the V region of the VL chain of anti-DLL4 Hits.

TABLE 18E

Anti-DLL4 antibody variants

| Parent anti-DLL4 VH chain Hit | Mutation(s) | SEQ ID NO Nucleotide | Amino acid | Parent anti DLL4 VL chain Hit | Mutation(s) | SEQ ID NO Nucleotide | Amino acid |
|---|---|---|---|---|---|---|---|
| IGHV5-51*03; IGHD5-18*01>3; IGHJ4*01 | G100K | 3741 | 3720 | IGLV8-61*01; IGLJ1*01 | n/a | 1465 | 1881 |

TABLE 18E-continued

Anti-DLL4 antibody variants

| Parent anti-DLL4 VH chain Hit | Mutation(s) | SEQ ID NO Nucleotide | SEQ ID NO Amino acid | Parent anti DLL4 VL chain Hit | Mutation(s) | SEQ ID NO Nucleotide | SEQ ID NO Amino acid |
|---|---|---|---|---|---|---|---|
| IGHV5-51*03; IGHD5-18*01>3; IGHJ4*01 | G100R | 3742 | 3721 | IGLV8-61*01; IGLJ1*01 | n/a | 1465 | 1881 |
| IGHV5-51*03; IGHD5-18*01>3; IGHJ4*01 | G104T | 3745 | 3724 | IGLV8-61*01; IGLJ1*01 | n/a | 1465 | 1881 |
| IGHV5-51*03; IGHD5-18*01>3; IGHJ4*01 | G100K/ G104T | 3749 | 3728 | IGLV8-61*01; IGLJ1*01 | n/a | 1465 | 1881 |
| IGHV1-46*01; IGHD6-6*01; IGHJ1*01 | S104F | 3743 | 3722 | IGKV3-11*01; IGKJ1*01 | n/a | 1434 | 1850 |
| IGHV1-46*01; IGHD6-6*01; IGHJ1*01 | S104A | 3744 | 3723 | IGKV3-11*01; IGKJ1*01 | n/a | 1434 | 1850 |
| IGHV1-46*01; IGHD6-6*01; IGHJ1*01 | S103P | 3746 | 3725 | IGKV3-11*01; IGKJ1*01 | n/a | 1434 | 1850 |
| IGHV1-46*01; IGHD6-6*01; IGHJ1*01 | S102A | 3747 | 3726 | IGKV3-11*01; IGKJ1*01 | n/a | 1434 | 1850 |
| IGHV1-46*01; IGHD6-6*01; IGHJ1*01 | S102A/ S103P/ S104F | 3748 | 3727 | IGKV3-11*01; IGKJ1*01 | n/a | 1434 | 1850 |
| IGHV1-46*01; IGHD6-6*01; IGHJ1*01 | S102A/ S103P/ S104F/ H111F | 3750 | 3729 | IGKV3-11*01; IGKJ1*01 | n/a | 1434 | 1850 |
| IGHV1-46*01; IGHD6-6*01; IGHJ1*01 | S102A/ S103P/ S104F/ H111Y | 3751 | 3730 | IGKV3-11*01; IGKJ1*01 | n/a | 1434 | 1850 |
| IGHV1-46*01; IGHD6-6*01; IGHJ1*01 | S102A/ S103P/ S104Y/ H111Y | 3752 | 3731 | IGKV3-11*01; IGKJ1*01 | n/a | 1434 | 1850 |
| IGHV1-46*01; IGHD6-6*01; IGHJ1*01 | S102A/ S103P/ S104F | 3748 | 3727 | IGKV3-11*01; IGKJ1*01 | S28P | 3753 | 3735 |
| IGHV1-46*01; IGHD6-6*01; IGHJ1*01 | S102A/ S103P/ S104F | 3748 | 3727 | IGKV3-11*01; IGKJ1*01 | S30N | 3754 | 3733 |
| IGHV1-46*01; IGHD6-6*01; IGHJ1*01 | S102A/ S103P/ S104F | 3748 | 3727 | IGKV3-11*01; IGKJ1*01 | S31K | 3755 | 3734 | ii. ErbB Family

Group I receptor tyrosine kinases, including EGFR (ErbB-1), HER2/c-neu (ErbB-2), Her 3 (ErbB-3) and Her 4 (ErbB-4), are widely expressed in epithelial, mesenchymal, and neuronal tissues and play fundamental roles in proliferation and differentiation. They are activated by a family of ligands that variously bind to the receptors. For example, epidermal growth factor (EGF), transforming growth factor alpha (TGF-alpha) and amphiregulin bind to ErbB1, but not to other receptors. The neuregulins bind to ErbB3 and ErbB4. Finally, b-cellulin (BTC), heparin-binding EGF and epiregulin bind to ErbB1 and ErbB4. ErbB2 has no characterized ligand, but can be activated by homodimerization in trans by heterodimerization with another ErbB family member.

a) Epidermal Growth Factor Receptor (EGFR)

The epidermal growth factor receptor (EGFR; ErbB-1; HER1 in humans; set forth in SEQ ID NO:2000) is a cell-surface receptor for members of the epidermal growth factor family (EGF-family) of extracellular protein ligands. Upon binding by the ligand epidermal growth factor (EGF), EGFR dimerizes stimulating its intrinsic intracellular protein-tyrosine kinase activity. This autophosphorylation elicits downstream activation and signaling by several other proteins that associate with the phosphorylated tyrosines through their own phosphotyrosine-binding SH2 domains. These downstream signaling proteins initiate several signal transduction cascades, including MAPK, Akt and JNK pathways, leading to DNA synthesis and cell proliferation. Such proteins modulate phenotypes such as cell migration, adhesion, and proliferation. Therefore, mutations affecting EGFR expression or activity can result in cancer Upregulation of EGFR is associated with poor cancer prognosis. ERBITUX® (cetuximab) is a chimeric monoclonal antibody approved for the treatment of colorectal and/or head and neck cancers. ERBITUX® binds the EGFR and thereby prevents intracellular signaling associated with DNA synthesis and cell proliferation. VECTIBIX® (panitumumab) is a fully human monoclonal antibody approved for the treatment of EGFR-expressing, metastatic colorectal carcinoma. Both ERBITUX® and VECTIBIX® can be used alone or in conjuction with a chemotherapeutic agent.

Antibody libraries provided herein can be screened for modulation of an acitivity by assaying for binding to EGFR and/or assaying for a functional activity, for example, signal transduction, cell migration, adhesion, and proliferation. Functional assays can be performed in the presence or absence of the EGF ligand. Example 13 exemplifies a binding assay to screen antibody libraries provided herein to select or identify antibodies that bind to EGFR.

The antibodies or portions thereof identified from the libraries provided herein that modulate an activity of EGFR can be used for the treatment or prevention of disease states associated with expression and/or activity of EGFR. For example, the antibodies or portions thereof can be used in the treatment of cancers including, but not limited to, glioblastoma, head and neck cancer, pancreatic cancer, colorectal cancer, lung cancer, cancer of the nervous system, gastrointestinal cancer, prostate cancer, ovarian cancer, breast cancer, kidney cancer, retina cancer, skin cancer, liver cancer, genital-urinary cancer, bladder cancer, or a lung cancer such as a lun adenocarcinoma, lung squamous cell carcinoma or non-small cell lung cancer.

Provided herein are antibodies that modulate the activity of EGFR and therefore can be used in the treatment of diseases or conditions associated with expression or activity of EGFR. Such antibodies include those that have a VH chain and a VL chain encoded by a sequence of nucleotides compiled from germline segments, or any antibodies optimized therefrom. Exemplary of such antibodies are Fab antibodies. The antibodies further can contain a constant region. The antibodies include those that have a binding affinity for EGFR that is or is about $10^{-6}$ M, $10^{-7}$ M, $10^{-8}$ M, $10^{-9}$ M, $10^{-10}$ M, $10^{-11}$ M, $10^{-12}$ M or lower, in particular any that have a nanomolar or sub-nanomolar binding affinity.

Anti-EGFR antibodies provided herein include antibodies having at least one CDR that is a CDRH1, CDRH2, CDRH3, CDRL1, CDRL2 and/or CDRL3. For example, a CDRH1 is GYTFTSYYMH (amino acids 26-35 of SEQ ID NO:1508); a CDRH2 is IINPSGGSTSYAQKFQG (amino acids 50-66 of SEQ ID NO:1508); a CDRH3 is EGYCSGGSCYSYWY-FDL (amino acids 99-115 of SEQ ID NO:1508); a CDRH3 is EGYSSSWYDYFDY (amino acids 99-111 of SEQ ID NO:1512); a CDRL1 is RASQSVSSNLA (amino acids 24-34 of SEQ ID NO:1843); a CDRL1 is RASQSISSWLA (amino acids 24-34 of SEQ ID NO:1841); a CDRL2 is GASTRAT (amino acids 50-56 of SEQ ID NO:1843); a CDRL2 is DASSLES (amino acids 50-56 of SEQ ID NO:1841); a CDRL3 is QQYNNWPPWT (amino acids 89-98 of SEQ ID NO:1843); and a CDRL3 is QQYNSYSPWT (amino acids 89-98 of SEQ ID NO:1841). Also provided herein is a CDR that exhibits 60%, 65%, 70%, 80%, 90%, 91%, 92%, 93%, 94%, 95%, 96%, 97%, 98%, 99% or more sequence identity to any of the above CDRs.

For example, antibodies that modulate an activity of EGFR include any that contain a VH chain encoded by a sequence of nucleotides containing germline components compiled from a $V_H$ germline segment that is an IGHV1 (e.g. any set forth in any of SEQ ID NOS:1-43); a $D_H$ germline segment that is an IGHD6 (e.g. any set forth in SEQ ID NOS: 268-271) or an IGHD2 (e.g. any set forth in SEQ ID NOS: 244-251); and a $J_H$ germline segment that is an IGHJ2 (e.g., set forth in SEQ ID NO:274) or an IGHJ4 (e.g. set forth in SEQ ID NO: 278 or 279). Such antibodies also include any that contain a VL chain encoded by a sequence of nucleotides containing germline components compiled from a V germline segment that is an IGKV1 (set forth in any of SEQ ID NOS: 286-316) or an IGKV3 (e.g. any set forth in any of SEQ ID NOS:332-350); and a J germline segment that is an IGKJ1 (e.g. set forth in SEQ ID NO: 356). Such antibodies also include any that are encoded by a sequence of nucleotides containing germline segments that are variants of any of the above germline segments, for example due to conservative mutations or other mutations, so long as the resulting antibody is a functional and productive antibody and binds to EGFR and/or modulates a functional activity.

Exemplary of antibodies against EGFR include an antibody where the VH chain is encoded by a sequence of nucleotides compiled from a $V_H$ germline segment that is a IGHV1-46 (e.g. an IGHV1-46*01, IGHV1-46*01, or an IGHV1-46*03); a $D_H$ germline segment that is an IGHD2-15 (e.g. IGHD2-15*01) or an IGHD6-13 (e.g. IGHD6-13*01); and a JH germline segment that is an IGHJ2*01 or an IGHJ4 (e.g. IGHJ4*01, IGHJ4*02, IGHJ4*03). The VL chain is encoded by a sequence of nucleotides compiled from a V germline segment that is an IGKV1-5 (e.g. IGKV1-5*01, IGKV1-5*02, IGKV1-5*03) or an IGKV3-15(e.g. IGHV3-15*01); and a J germline segment that is a IGKJ1*01. Exemplary antibodies provided herein that modulate an activity of EGFR are set forth in Table 18F.

TABLE 18F

Anti-EGFR Antibodies

| Heavy Chain Germline Segments | SEQ ID NO nucleotide | SEQ ID NO Amino acid | Light Chain Germline Segments | SEQ ID NO nucleotide | SEQ ID NO Amino acid |
|---|---|---|---|---|---|
| IGHV1-46*01; IGHD2-15*01; IGHJ2*01 | 1092 | 1508 | IGKV3-15*01; IGKJ1*01 | 1427 | 1841 |
| IGHV1-46*01; IGHD6-13*01; IGHJ4*01 | 1096 | 1512 | IGKV3-15*01; IGKJ1*01 | 1427 | 1841 |
| IGHV1-46*01; IGHD2-15*01; IGHJ2*01 | 1092 | 1508 | IGKV1-5*01; IGKJ1*01 | 1425 | 1843 | b) Human Epidermal Growth Factor Receptor 2 (HER2/neu)

HER2/neu (ErbB-2; set forth in SEQ ID NO: 1999) is a cell membrane surface-bound receptor tyrosine kinase normally involved in the signal transduction pathways leading to cell growth and differentiation. ErbB-2 is thought to be an orphan receptor, with none of the EGF family of ligands able to activate it. However, ErbB receptors dimerize on ligand binding, and ErbB-2 is the preferential dimerization partner of other members of the ErbB family. ErbB2 activation leads to kinase activation and cell proliferation. ErbB-2 is notable for its role in the pathogenesis of breast cancer and therefore as a target for treatment. In fact, ErbB-2 protein overexpression is observed in 25-30% of primary breast cancers. HERCEPTIN® (trastuzumab) is a recombinant DNA-derived humanized monoclonal antibody, used to treat breast cancer, that selectively binds to the extracellular domain of ErbB-2 Thus, ErbB-2 is an attractive target for additional protein therapeutics. See e.g. Carter et al., (1992) *Proc. Natl. Acad. Sci. USA,* 89:4285-4289; and U.S. Pat. No. 5,725,856.

Antibody libraries provided herein can be screened for modulation of an acitivity by assaying for binding to ErbB-2 and/or assaying for a functional activity, for example, signal transduction, cell migration, adhesion, and proliferation. For example, cells that are known to express ErbB-2 can be assessed for proliferation in the presence or absence of an antibody or portion thereof. Alternatively, reporter system assays can be constructed, whereby the expression of a reporter protein, such as luciferase, is dependent on the activiation of ErbB2 (see e.g. Ueda et al. (2004) J Biol. Chem., 279:24505-24513). Assays can be performed in the presence of EGF, TGF or other ErbB lignads that are ligands for ErbB-2 binding partners. Example 13 exemplifies a binding assay to screen antibody libraries provided herein to select or identify antibodies that bind to ErbB-2.

The antibodies or portions thereof identified from the libraries provided herein that modulate an activity of ErbB-2 can be used for the treatment or prevention of disease states associated with expression and/or activity of ErbB-2. For example, the antibodies or portions thereof can be used in the treatment of proliferative diseases such as cancers, including, but not limited to, breast cancer, ovarian cancer, colon cancer, lung cancer and prostate cancer.

Provided herein are antibodies that modulate the activity of ErbB-2 and therefore can be used in the treatment of diseases or conditions associated with expression or activity of ErbB-2. Such antibodies include those that have a VH chain and a VL chain encoded by a sequence of nucleotides compiled from germline segments, or any antibodies optimized therefrom. Exemplary of such antibodies are Fab antibodies. The antibodies further can contain a constant region. The antibodies include those that have a binding affinity for ErbB-2 that is or is about $10^{-6}$ M, $10^{-7}$ M, $10^{-8}$ M, $10^{-9}$ M, $10^{-10}$ M, $10^{-11}$ M, $10^{-12}$ M or lower, in particular any that have a nanomolar or sub-nanomolar binding affinity.

Anti-ErbB-2 antibodies provided herein include antibodies having at least one CDR that is a CDRH1, CDRH2, CDRH3, CDRL1, CDRL2 and/or CDRL3. For example, a CDRH1 is GGSISSGGYYWS (amino acids 26-37 of SEQ ID NO:1760); a CDRH1 is GYTFTSYYMH (amino acids 26-35 of SEQ ID NO:1512); a CDRH1 is GFSLSTSGVGVG (amino acids 26-37 of SEQ ID NO:1559); a CDRH1 is GGTFSSYAIS (amino acids 26-35 of SEQ ID NO:1522); a CDRH2 is YIYYSGSTYYNPSLKS (amino acids 52-67 of SEQ ID NO:1760); a CDRH2 is IINPSGGSTSYAQKFQG (amino acids 50-66 of SEQ ID NO:1512); a CDRH2 is LIYWNDDKRYSPSLKS (amino acids 52-67 of SEQ ID NO:1559); a CDRH2 is GIIPIFGTANYAQKFQG (amino acids 50-66 of SEQ ID NO:1522); a CDRH3 is EGYSSSWYDYFDY (amino acids 100-112 of SEQ ID NO:1760); a CDRH3 is GYSGSYYYWYFDL (amino acids 99-111 of SEQ ID NO:1512); a CDRH3 is EEYSSSSAEYKQH (amino acids 99-111 of SEQ ID NO:1513); a CDRH3 is RPNWGYWYFDL (amino acids 100-110 of SEQ ID NO:1559); a CDRH3 is GYNWNDDYYYYYGMDV (amino acids 99-114 of SEQ ID NO:1522); a CDRL1 is RASQSVSSYLA (amino acids 24-35 of SEQ ID NO:1833); a CDRL1 is KSSQSVLYSSNNKNYLA (amino acids 24-40 of SEQ ID NO:1838); a CDRL1 is RASQSVSSNLA (amino acids 24-34 of SEQ ID NO:1843); a CDRL1 is RSSQSLVYSDGNTYLN (amino acids 24-39 of SEQ ID NO:1828); a CDRL2 is GASSRAT (amino acids 51-57 of SEQ ID NO:1833); a CDRL2 is WASTRES (amino acids 56-62 of SEQ ID NO:1838); a CDRL2 is GASTRAT (amino acids 50-56 of SEQ ID NO:1843); a CDRL2 is KVSNDRS (amino acids 55-61 of SEQ ID NO:1828); a CDRL3 is QQYGSSPPWT (amino acids 90-99 of SEQ ID NO:1833); a CDRL3 is QQYYSTPPWT (amino acids 95-104 of SEQ ID NO:1838); a CDRL3 is QQYNNWPPWT (amino acids 89-98 of SEQ ID NO:1843); and a CDRL3 is MQGTHWPPWT (amino acids 94-103 of SEQ ID NO:1828). Also provided herein is a CDR that exhibits 60%, 65%, 70%, 80%, 90%, 91%, 92%, 93%, 94%, 95%, 96%, 97%, 98%, 99% or more sequence identity to any of the above CDRs.

For example, antibodies that modulate an activity of ErbB-2 include any that contain a VH chain encoded by a sequence of nucleotides containing germline components compiled from a $V_H$ germline segment that is an IGHV4 (e.g. any set forth in any of SEQ ID NOS:153-224), an IGHV1 (e.g. any set forth in SEQ ID NOS: 10-43), or an IGHV2 (e.g. any set forth in SEQ ID NOS:44-67); a $D_H$ germline segment that is an IGHD6 (e.g. any set forth in SEQ ID NOS: 268-271); an IGHD1 (e.g. any set forth in any of SEQ ID NOS: 239-243), or an IGHD7 (e.g. set forth in SEQ ID NO:272); and a $J_H$ germline segment that is an IGHJ1 (e.g., set forth in SEQ ID NO:273), an IGHJ2 (e.g. set forth in SEQ ID NO:274), an IGHJ4 (e.g. set forth in any of SEQ ID NOS: 277-279), or an IGHJ6 (e.g. set forth in any of SEQ ID NOS:282-285). Such antibodies also include any that contain a VL chain encoded by a sequence of nucleotides containing germline components compiled from a V germline segment that is a IGKV3 (e.g. any set forth in any of SEQ ID NOS: 332-350), a IGKV4 (e.g. set forth in SEQ ID NO:351), or an IGKV2 (e.g. set forth in SEQ ID NOS:317-331); and a J germline segment that is an IGKJ1 (e.g. set forth in SEQ ID NO: 356). Such antibodies also include any that are encoded by a sequence of nucleotides containing germline segments that are variants of any of the above germline segments, for example due to conservative mutations or other mutations, so long as the resulting antibody is a functional and productive antibody and binds to ErbB-2 and/or modulates a functional activity.

Exemplary of antibodies against ErbB-2 include an antibody where the VH chain is encoded by a sequence of nucleotides compiled from a $V_H$ germline segment that is a IGHV4-31 (e.g. an IGHV4-31*01, IGHV4-31*02, IGHV4-31*03, IGHV4-31*04, IGHV4-31*05, IGHV4-31*06, IGHV4-31*07, IGHV4-31*08, IGHV4-31*09, IGHV4-31*10), an IGHV1-46 (e.g.,IGHV1-46*01, IGHV1-46*02, IGHV1-46*03) an IGHV2-5 (e.g. IGHV2-5*01, IGHV2-5*02; IGHV2-5*03, IGHV2-5*04, IGHV2-5*05, IGHV2-5*06, IGHV2-5*07, IGHV2-5*08, IGHV2-5*09, IGHV2-5*10) IGHV1-69 (e.g. IGHV1-69*01, IGHV1-69*02, IGHV1-69*03, IGHV1-69*04, IGHV1-69*05, IGHV1-69*06, IGHV1-69*07, IGHV1-69*08, IGHV1-69*09, IGHV1-69*10, IGHV1-69*11, IGHV1-69*12, IGHV1-69*13); a $D_H$ germline segment that is a IGHD6-6 (e.g. IGHD6-6*01), an IGHD6-13 (e.g. IGHD6-13*01), an IGHD1-26 (e.g. IGHD1-26*01), an IGHD7-27*01, or an IGHD1-1*01; and a JH germline segment that is an IGHJ1*01, an IGHJ2*01, an IGHJ4 (e.g. IGHJ4*01, IGHJ4*02, IGHJ4*03) or an IGHJ6 (e.g. IGHJ6*01, IGHJ6*02, IGHJ6*03, IGHJ6*04). The VL chain is encoded by a sequence of nucleotides compiled from a V germline segment that is a IGKV3-20 (e.g. IGHV3-20*01 or IGHV3-20*02), a IGKV4-1 (e.g. IGKV4-1*01), an IGKV3-15*01, or an IGKV2-30*01; and a J germline segment that is a IGKJ1*01. Exemplary antibodies provided herein that modulate an activity of ErbB-2 are set forth in Table 18G.

TABLE 18G

Anti-ErbB2 Antibodies

| Heavy Chain Germline Segments | SEQ ID NO nucleotide | SEQ ID NO Amino acid | Light Chain Germline Segments | SEQ ID NO nucleotide | SEQ ID NO Amino acid |
|---|---|---|---|---|---|
| IGHV4-31*02; IGHD1-26*01; IGHJ2*01 | 1344 | 1760 | IGKV3-20*01; IGKJ1*01 | 1417 | 1833 |
| IGHV1-46*01, IGHD6-6*01 and IGHJ1*01 | 1097 | 1513 | IGKV4-1*01; IGKJ1*01 | 1422 | 1838 |
| IGHV1-46*01; IGHD6-13*01; IGHJ4*01 | 1096 | 1512 | IGKV4-1*01; IGKJ1*01 | 1422 | 1838 |
| IGHV2-5*01; IGHD7-27*01; IGHJ2*01 | 1143 | 1559 | IGKV3-15*01; IGKJ1*01 | 1427 | 1843 |
| IGHV1-69*06; IGHD1-1*01; IGHJ6*01 | 1106 | 1522 | IGKV2-30*01; IGKJ1*01 | 1412 | 1828 | iii. IGF-R1 (Insulin-Like Growth Factor 1 Receptor)

Insulin-like Growth Factor 1 Receptor (IGF-R1; set forth in SEQ ID NO:2007) is a transmembrane receptor activated by Insulin-like Growth Factor 1 (IGF-1) and Insulin-like Growth Factor 2 (IFG-2). Overexpression of Insulin-like Growth Factor Receptor-I has been demonstrated in several cancer cell lines and tumor tissues. IGFR1 is overexpressed in 40% of all breast cancer cell lines (Pandini, et al., (1999) Cancer Res. 5: 1935) and in 15% of lung cancer cell lines. In breast cancer tumor tissue, IGFR1 is overexpressed 6-14 fold and IGFR1 exhibits 2-4 fold higher kinase activity as compared to normal tissue (Webster, et al., (1996) Cancer Res. 56: 2781 and Pekonen, et al., (1998) Cancer Res. 48: 1343). Moreover, colorectal cancer tissue has been reported to exhibit strongly elevated IGFR1 levels (Weber et al., Cancer 95 (10): 2086-95 (2002)). Analysis of primary cervical cancer cell cultures and cervical cancer cell lines revealed 3-and 5-fold overexpression of IGFR1, respectively, as compared to normal ectocervical cells (Steller, et al., (1996) Cancer Res, 56: 1762). Expression of IGFR1 in synovial sarcoma cells also correlated with an aggressive phenotype (i.e., metastasis and high rate of proliferation; Xie, et al., (1999) Cancer Res. 59: 3588).

Activation of IGF-R1 causes survival and proliferation of mitosis-competent cells and growth in tissues such as skeletal muscle and cardiac muscle. The IGF-1 receptor is implicated in several cancers, most notably breast cancer. IGF-R1 can serve to increase the metastatic potential of the tumor by inferring the ability of the tumor to promote vascularization. In addition, IGF-R1's anti-apoptotic properties allow cancer cells to evade the cytotoxic properties of chemotherapeutic drugs or radiation. Crosstalk can occur between IGF-R1 and EGFR allowing EGFR signaling to resume, even in the presence of EGFR inhibitors. Inhibition of IGF-1R mediated signaling has been shown to reduce tumor growth rate, increase apoptosis, and increase killing of tumors by chemotherapy and other molecular target therapies.

Experimental approaches undertaken to inhibit IGF-1R function in tumors have provided encouraging but limited success, and their effectiveness in treating cancer is yet to be determined in the clinic. The ability of an antibody to inhibit IGF-R1 function was first demonstrated with a mouse monoclonal antibody (-IR3) targeting an unknown epitope in the subunit of IGF-1R (Kull et al., (1983) J. Biol. Chem. 258: 6561-66). Subsequently other antibodies developed to the subunit of IGF-1R have been shown to inhibit IGF-R1 function to varying degrees in different experimental cancer models. There remains a need for IGF-1R antibodies with different or improved binding, efficacy, and safety characteristics for the treatment of various neoplastic diseases including cancer and metastases thereof.

Antibody libraries provided herein can be screened for modulation of an acitivity by assaying for binding to IGF-R1 and/or assaying for a functional activity, for example, cell proliferation. Assays can be peformed in the presence of IGF-1 or IGF-2. Example 13 exemplifies a binding assay to screen antibody libraries provided herein to select or identify antibodies that bind to IGF-R1.

The antibodies or portions thereof identified from the libraries provided herein that modulate an activity of IGF-R1 can be used for the treatment or prevention of disease states associated with expression and/or activity of IGF-R1. For example, the antibodies or portions thereof can be used in the treatment of rheumatoid arthritis, Grave's disease, multiple sclerosis, systemin lupus erythematosus, Hashimoto's Thyroiditis, Myasthenia Gravis, auto-immune thyroiditis, Bechet's disease, acromegaly, bladder cancer, Wilm's cancer, ovarian cancer, pancreatic cancer, benign prostatic hyperplasia, breast cancer, prostate cancer, bone cancer, lung cancer, colorectal cancer, cervical canner, synovial sarcoma, diarrhea associated with metastatic carcinoid, vasoactive intestinal peptide secreting tumors, gigantism, psoriasis, atherosclerosis, smooth muscle restenosis of blood vessels or inappropriate microvascular proliferation.

iv. C-Met

C-Met (or hepatocyte growth factor receptor, HGFR; set forth in SEQ ID NO: 2001) is a membrane receptor found in cells of epithelial origin, including stem cells and progenitor cells. Upon stimulation of c-Met by its ligand, hepatocyte growth factor (HGF), c-Met induces several biological responses that trigger invasive growth, including mitogenesis, motogenesis and morphogenesis. C-Met also is expressed in tumor cell lines and in various human solid tumors. Abnormal c-Met activation in cancer cells correlates with poor prognosis and triggers tumor growth, angiogenesis and metastasis. C-Met engages multiple oncogenic signal transduction pathways, including RAS, which leads to morphogenesis; PI3K, which is associated with cell motility; STAT, which induces branching morphogenesis; and beta catenin, which participates in transcriptional regulation of numerous genes. HGF, through c-Met, has also been shown to be a mitogen for certain cell types, including melanocytes, renal tubular cells, keratinocytes, certain endothelial cells and cells of epithelial origin [Matsumoto et al., Biochem. Biophys. Res. Commun. 176: 45-51 (1991); Igawa et al., Biochem. Biophys. Res. Commun. 174: 831-838 (1991); Han et al., Biochem., 30: 9768-9780 (1991); Rubin et al., Proc. Natl. Acad. Sci. USA, 88: 415-419 (1991)].

Several cancer therapies involve interference of c-Met signaling. These therapies include kinase inhibitors, that prevent ATP from binding to c-Met preventing transphosphorylation; HGF inhibitors, that prevent HGF activation of c-Met; decoy MET inhibitors, that prevent ligand binding and homodimerization; and immunotherapy, including passive immunotherapy which activates CDC or ADCC and active immunotherapy with cytokines triggering non-specific stiulation of immune cells. In view of the important role that this pathway plays in the etiology of various pathological conditions, however, it is clear that there continues to be a need for agents that have clinical attributes that are optimal for development as therapeutic agents.

Antibody libraries provided herein can be screened for modulation of an acitivity by assaying for binding to c-Met and/or assaying for a functional activity, for example, cell proliferation or cell signaling. Assays can be performed in the presence of HGF. Example 13 exemplifies a binding assay to screen antibody libraries provided herein to select or identify antibodies that bind to c-Met.

The antibodies or portions thereof identified from the libraries provided herein that modulate an activity of c-Met can be used for the treatment or prevention of disease states associated with expression and/or activity of c-Met. For example, the antibodies or portions thereof can be used in the treatment of lung cancer, bone cancer, pancreatic cancer, skin cancer, cancer of the head and neck, cutaneous or intraocular melanoma, uterine cancer, ovarian cancer, rectal cancer, cancer of the anal region, stomach cancer, colon cancer, breast cancer, gynecologic tumors (e.g., uterine sarcomas, carcinoma of the fallopian tubes, carcinoma of the endometrium, carcinoma of the cervix, carcinoma of the vagina or carcinoma of the vulva), Hodgkin's disease, cancer of the esophagus, cancer of the small intestine, cancer of the endocrine system (e.g., cancer of the thyroid, parathyroid or adrenal glands), sarcomas of soft tissues, cancer of the urethra, cancer of the penis, prostate cancer, chronic or acute leukemia, solid tumors of childhood, lymphocytic lymphomas, cancer of the bladder, cancer of the kidney or ureter (e. g., renal cell carcinoma, carcinoma of the renal pelvis), or neoplasms of the central nervous system (e.g., primary CNS lymphoma, spinal axis tumors, brain stem gliomas or pituitary adenomas).

Anti-c-Met antibodies provided herein include antibodies having at least one CDR that is a CDRH1, CDRH2, CDRH3, CDRL1, CDRL2 and/or CDRL3. For example, a CDRH1 is GFTFSSYAMS (amino acids 26-35 of SEQ ID NO:3353); a CDRH2 is SISGSGGSTYYADSVKG (amino acids 50-66 of SEQ ID NO:3353); a CDRH3 is EHIVVVIAISYYYYYYG-MDV (amino acids 99-118 of SEQ ID NO:3353); a CDRH3 is EDIVVVPAAMSYYYYYYGMDV (amino acids 99-119 of SEQ ID NO:3347); a CDRH3 is EDIVLMVYAI-SYYYYYYGMDV (amino acids 99-119 of SEQ ID NO:3349); a CDRH3 is EDIVVVVAATSYYYYYYGMDV (amino acids 99-119 of SEQ ID NO:3351); a CDRL1 is QGDSLRSYYAS (amino acids 22-33 of SEQ ID NO:1870); a CDRL2 is GKNNRPS (amino acids 49-55 of SEQ ID NO:1870); and a CDRL3 is NSRDSSGNHLW (amino acids 88-99 of SEQ ID NO:1870). Also provided herein is a CDR that exhibits 60%, 65%, 70%, 80%, 90%, 91%, 92%, 93%, 94%, 95%, 96%, 97%, 98%, 99% or more sequence identity to any of the above CDRs.

For example, antibodies that modulate an activity of c-Met include any that contain a VH chain encoded by a sequence of nucleotides containing germline components compiled from a $V_H$ germline segment that is an IGHV3 (e.g. any set forth in SEQ ID NOS: 68-152); a $D_H$ germline segment that is an IGHD2 (e.g., any set forth in any of SEQ ID NOS:244-251); and a $J_H$ germline segment that is an IGHJ6 (e.g. any set forth in SEQ ID NOS: 282-285), or is a modified form of a $J_H$ germline segment, for example, set forth in SEQ ID NO: 3455. Such antibodies also include any that contain a VL chain encoded by a sequence of nucleotides containing germline components compiled from a V germline segment that is an IGLV3 (e.g. set forth in SEQ ID NO: 400-417); and a J germline segment that is an IGLJ2 (e.g. set forth in SEQ ID NO: 443). Such antibodies also include any that are encoded by a sequence of nucleotides containing germline segments that are variants of any of the above germline segments, for example due to conservative mutations or other nucleotide mutations, so long as the resulting antibody is a functional and productive antibody and binds to c-Met and/or modulates a functional activity.

Exemplary of antibodies against c-Met include an antibody where the VH chain is encoded by a sequence of nucleotides compiled from a $V_H$ germline segment that is an IGHV3-23 (e.g. IGHV3-23*01, IGHV3-23*02, IGHV3-23*03, IGHV3-23*04 or IGHV3-23*05); a $D_H$ germline segment that is an IGHD2-15*01, an IGHD2-2 (e.g. IGHD2-2*01, IGHD2-2*02, or IGHD2-2*03), an IGHD2-8 (e.g. IGHD2-8*01 or IGHD2-8*02), or an IGHD2-21 (e.g. IGHD2-21*01 or IGHD2-21*02); and a JH germline segment that is an IGHJ6 (e.g. IGHJ6*01, IGHJ6*02, IGHJ6*03, IGHJ6*04), or any modified form thereof, for example, set forth in SEQ ID NOS: 3455. The VL chain is encoded by a sequence of nucleotides compiled from a a V germline segment that is an IGLV3-19*01; and a J germline segment that is an ILGJ2*01. Exemplary antibodies provided herein that modulate an activity of EpoR are set forth in Table 18H.

TABLE 18H

Anti-HGFR Antibodies

| Heavy Chain Germline Segments | SEQ ID NO nucleotide | SEQ ID NO Amino acid | Light Chain Germline Segments | SEQ ID NO nucleotide | SEQ ID NO Amino acid |
|---|---|---|---|---|---|
| IGHV3-23*01; IGHD2-21*01>3; IGHJ6*01 | 2663 | 3353 | IGLV3-19*01; IGLJ2*01 | 1454 | 1870 |
| IGHV3-23*01; IGHD2-2*01>3; IGHJ6*01 | 2657 | 3347 | IGLV3-19*01; IGLJ2*01 | 1454 | 1870 |
| IGHV3-23*01; IGHD2-8*01>3; IGHJ6*01 | 2659 | 3349 | IGLV3-19*01; IGLJ2*01 | 1454 | 1870 |
| IGHV3-23*01; IGHD2-15*01>3; IGHJ6*01 | 2661 | 3351 | IGLV3-19*01; IGLJ2*01 | 1454 | 1870 | v. CD20—B-Lymphocyte Antigen

CD20 (human B-lymphocyte-restricted differentiation antigen, Bp35; set forth in SEQ ID NO: 2011), is a hydrophobic transmembrane protein located on pre-B and mature B lymphocytes. CD20 is found on the surface of greater than 90% of B cells from peripheral blood or lymphoid organs and is expressed during early pre-B cell development and remains until plasma cell differentiation. CD20 is present on both normal B cells as well as malignant B cells. In particular, CD20 is expressed on greater than 90% of B cell non-Hodgkin's lymphomas (NHL) (Anderson et al. (1984) *Blood* 63(6):1424-1433), but is not found on hematopoietic stem cells, pro-B cells, normal plasma cells, or other normal tissue (Tedder et al. (1985) *J. Immunol.* 135(2):973-979). CD20 also is expressed on tumor cells, e.g. NHL.

CD20 regulates an early step in the activation process for cell cycle initiation and differentiation. CD20 functions as an ion channel and operates as a store of calcium facilitating entry of extracellular calcium following BCR-induced emptying of intracellular stores (see e.g., Teeling et al. (2006) J Immunol., 177:362-371). Due to the expression of CD20 on almost all B-cells, but not stem cells, it is a target for antigenic modulation via mAb induced antibody-dependent cellular cytotoxicity and complement-dependent cytotoxicity. In addition, when engaged by antibody, CD20 initiates signaling that can control growth and triggering cell death in tumors (Teeling et al. (2006) J Immunol., 177:362-371).

CD20 has been validated as a cancer cell target by RITUXAN® (Rituximab), a genetically engineered chimeric murine/human monoclonal antibody directed against the CD20 antigen found on the surface of normal and malignant B lymphocytes (see e.g. U.S. Pat. No. 5,736,137). RITUXAN® has been shown to induce B-cell lysis through apoptosis, complement-dependent cytotoxicity (CDC) and ADCC.

Antibody libraries provided herein can be screened for modulation of an acitivity by assaying for binding to CD20 and/or assaying for a functional activity, for example, complement-dependent cell-mediate cytotoxicity and killing of cells and apoptosis assays of cells expressing CD20. Example 13 exemplifies a binding assay to screen antibody libraries provided herein to select or identify antibodies that bind to CD20. Example 11 exemplifies a lymphoma apoptosis assay for assessing the function of cross-linked Fab antibodies.

The antibodies or portions thereof identified from the libraries provided herein that modulate an activity of CD20 can be used for the treatment or prevention of disease states associated with expression and/or activity of CD20. For example, the antibodies or portions thereof can be used in the treatment of lymphomas, autoimmune diseases and transplant rejections (e.g, to prevent rejection of organ and tissue grafts by suppressing autoimmune responses.) Lymphomas include, but are not limited to, non-Hodgkin's lymphomas (high-grade lymphomas, intermediate grade lymphomas, and low grade lymphomas), Hodgkin's disease, acute lymphoblastic leukemias, myelomas, chronic lymphocytic leukemias, and myeloblastic leukemias. Autoimmune diseases include, but are not limited to, systemic lupus erythematosus (SLE), rheumatoid arthritis, Crohn's disease, psoriasis, autoimmune thrombocytopenic purpura, multiple sclerosis, ankylosing spondylitis, myasthenia gravis, and pemphigus vulgaris.

vii. Erythropoietin Receptor (Epo-R)

Erythropoietin (Epo; set forth in SEQ ID NO: 2009) is a glycoprotein hormone that induces proliferation and differentiation of erythroid progenitor cells. Epo is responsible for promoting the growth, differentiation and survival of erythroid progenitors, which give rise to mature red blood cells. In response to changes in the level of oxygen in the blood and tissues, erythropoietin appears to stimulate both proliferation and differentiation of immature erythroblasts. It also functions as a growth factor, stimulating the mitotic activity of erythroid progenitor cells, such as erythrocyte burst forming and colony-forming units. It also acts as a differentiation factor, triggering transformation of an erythrocyte colony-forming-unit into a proerythroblast (See Erslev, A., *New Eng. J. Med.*, 316:101-103 (1987)).

The activity of Epo is mediated through the binding and activation of a cell surface receptor referred to as the erythropoietin receptor (EpoR). In the absence of ligands the Epo receptor exists in a preformed dimer. The binding of Epo to its receptor causes a conformational change such that the cytoplasmic domains are placed in close proximity. While not completely understood, it is believed that this "dimerization" plays a role in the activation of the receptor. The activation of the Epo receptor results in a number of biological effects. Some of these activities include stimulation of proliferation, stimulation of differentiation and inhibition of apoptosis (See U.S. Pat. No. 6,319,499, Liboi et al., *PNAS USA*, 90:11351 (1993), Koury, Science, 248:378 (1990)). Defects in the erythropoietin receptor can produce erythroleukemia and familial erythrocytosis.

Erythropoietin is an important pharmaceutical for use in a variety of therapies where stimulation of red blood cell proliferation (RBC) is desired. Epogen® (epoetin alfa) is a recombinant erythropoietin used to stimulate red blood cell proliferation and thereby treat anemia (see e.g. U.S. Pat. Nos. 4,703,008 and 5,955,422).

Antibody libraries provided herein can be screened for modulation of an acitivity by assaying for binding to EpoR and/or assaying for a functional activity, for example, proliferation, apoptosis or cell signaling. Example 13 exemplifies a binding assay to screen antibody libraries provided herein to select or identify antibodies that bind to EpoR. Example 12 and 18 exemplify assays to assess modulation of proliferation or apoptosis induced by EpoR. Hence, such assays can be used to identify agonist antibodies.

The antibodies or portions thereof identified from the libraries provided herein that modulate an activity of EpoR can be used for the treatment or prevention of disease states associated with expression and/or activity of EpoR. For example, the antibodies or portions thereof can be used in the treatment of disorders characterized by low red blood cell levels and/or decreased hemoglobin levels (e.g. anemia). In addition, such antibodies or portions thereof can be used for treating disorders characterized by decreased or subnormal levels of oxygen in the blood or tissue, such as, for example, hypoxemia or chronic tissue hypoxia and/or diseases characterized by inadequate blood circulation or reduced blood flow. Antibodies or antigen-binding portions thereof also can be useful in promoting wound healing or for protecting against neural cell and/or tissue damage, resulting from brain/spinal cord injury, stroke and the like. Non-limiting examples of conditions that can be treatable by the antibodies include anemia, such as chemotherapy-induced anemia, cancer associated anemia, anemia of chronic disease, HIV-associated anemia, bone marrow transplant-associated anemia and the like, heart failure, ischemic heart disease and renal failure.

Provided herein are antibodies that modulate the activity of EpoR and therefore can be used in the treatment of diseases or conditions associated with expression or activity of EpoR. Such antibodies include those that have a VH chain and a VL chain encoded by a sequence of nucleotides compiled from germline segments, or any antibodies optimized therefrom. Exemplary of such antibodies are Fab antibodies. The antibodies further can contain a constant region. The antibodies include those that have a binding affinity for EpoR that is or is about $10^{-6}$M, $10^{-7}$M, $10^{-8}$M, $10^{-9}$M, $10^{-10}$M, $10^{-11}$M, $10^{-12}$M or lower, in particular any that have a nanomolar or sub-nanomolar binding affinity.

Anti-EpoR antibodies provided herein include antibodies having at least one CDR that is a CDRH1, CDRH2, CDRH3, CDRL1, CDRL2 and/or CDRL3. For example, a CDRH1 is GYTFTSYYMH (amino acids 26-35 of SEQ ID NO:1509); a CDRH1 is SGYSISSSNWWG (amino acids $26-37 of SEQ ID NO:1759); a CDRH1 is GGSISSGGYYWS (amino acids 26-37 of SEQ ID NO:1769); a CDRH1 is GFTFSSYAMS (amino acids 26-35 of SEQ ID NO:3359); a CDRH2 is IINPSGGSTSYAQKFQG (amino acids 50-66 of SEQ ID NO:1509); a CDRH2 is YIYYSGSTYYNPSLKS (amino acids 51-66 of SEQ ID NO:1759); a CDRH2 is YIYYSGSTYYNPSLKS (amino acids 52-67 of SEQ ID NO:1769); a CDRH2 is SISGSGGSTYYADSVKG (amino acids 50-66 of SEQ ID NO:3359); a CDRH3 is EYYYGSGSYYNDYFDY (amino acids 99-114 of SEQ ID NO:1509); a CDRH3 is EGYSSSWYDYFDY (amino acids 99-111 of SEQ ID NO:1512); a CDRH3 is TNWGAEYFQH (amino acids 99-108 of SEQ ID NO:1759); a CDRH3 is ANWGDNWFDS (amino acids 100-109 of SEQ ID NO:1769); a CDRH3 is ANWGYWYFDL (amino acids 99-108 of SEQ ID NO:1514); a CDRH3 is EGYCSGGSCYSYWYFDL (amino acids 99-115 of SEQ ID NO:1508); a CDRH3 is GITMVRGVIISYYYYYYGMDV (amino acids 99-119 of SEQ ID NO:3359); a CDRL1 is RASQSVSSSYLA (amino acids 24-35 of SEQ ID NO:1833); a CDRL1 is KSSQSVLYSSNNKNYLA (amino acids 24-40 of SEQ ID NO:1838); a CDRL1 is RASQSVSSNLA (amino acids 24-34 of SEQ ID NO:1843); a CDRL1 is RASQSISSWLA (amino acids 24-34 of SEQ ID NO:1841); a CDRL1 is RSSQSLLDSDDGNTYLD (amino acids 24-40 of SEQ ID NO:1853); a CDRL1 is RASQSISSYLN (amino acids 24-34 of SEQ ID NO:1854); a CDRL1 is QGDSLRSYYAS (amino acids 23-33 of SEQ ID NO:1870); a CDRL2 is GASSRAT (amino acids 51-57 of SEQ ID NO:1833); a CDRL2 is WASTRES (amino acids 56-62 of SEQ ID NO:1838); a CDRL2 is GASTRAT (amino acids 50-56 of SEQ ID NO:1843); a CDRL2 is DASSLES (amino acids 50-56 of SEQ ID NO:1841); a CDRL2 is TLSYRAS (amino acids 56-62 of SEQ ID NO:1853); a CDRL2 is AASSLQS (amino acids 50-56 of SEQ ID NO:1854); a CDRL2 is GKNNRPS (amino acids 49-55 of SEQ ID NO:1870); a CDRL3 is QQYGSSPPWT (amino acids 90-99 of SEQ ID NO:1833); a CDRL3 is QQYYSTPPWT (amino acids 95-104 of SEQ ID NO:1838); a CDRL3 is QQYNNWPPWT (amino acids 89-98 of SEQ ID NO:1843); a CDRL3 is QQYNSYSPWT (amino acids 89-98 of SEQ ID NO:1841); a CDRL3 is MQRIEFPSWT (amino acids 95-104 of SEQ ID NO:1853); a CDRL3 is QQSYSTPPWT (amino acids 89-98 of SEQ ID NO:1854); and a CDRL3 is NSRDSSGNHLW (amino acids 88-99 of SEQ ID NO:1870). Also provided herein is a CDR that exhibits 60%, 65%, 70%, 80%, 90%, 91%, 92%, 93%, 94%, 95%, 96%, 97%, 98%, 99% or more sequence identity to any of the above CDRs.

For example, antibodies that modulate an activity of EpoR include any that contain a VH chain encoded by a sequence of nucleotides containing germline components compiled from a VH germline segment that is an IGHV1 (e.g. any set forth in SEQ ID NOS: 10-43), IGHV3 (e.g. any set forth in SEQ ID NOS: 68-152), or an IGHV4 (e.g. any set forth in SEQ ID NOS: 153-224); a DH germline segment that is an IGHD6 (e.g. any set forth in SEQ ID NOS: 268-271), an IGHD3 (e.g. any set forth in any of SEQ ID NOS: 252-259), an IGHD7 (e.g. any set forth in SEQ ID NO: 272); an IGHD2 (e.g., any set forth in any of SEQ ID NOS:244-251); and a $J_H$ germline segment that is an IGHJ1 (e.g., set forth in SEQ ID NO:273), IGHJ4 (e.g. set forth in SEQ ID NO:277-279), an IGHJ5 (e.g. set forth in SEQ ID NOS: 280 or 281), an IGHJ2 (e.g. set forth in SEQ ID NOS: 274), or an IGHJ6 (e.g. any set forth in SEQ ID NOS: 282-285), or is a modified form of a JH germline segment, for example, set forth in any of SEQ ID NOS: 3450-3455. Such antibodies also include any that contain a VL chain encoded by a sequence of nucleotides containing germline components compiled from a V germline segment that is an IGKV4 (e.g. set forth in SEQ ID NO:351), an IGKV3 (e.g. set forth in SEQ ID NOS:332-350); an IGKV1 (e.g. set forth in SEQ ID NOS:286-316 and 868); an IGKV2 (e.g. set forth in SEQ ID NOS:317-331); a J germline segment that is an IGKJ1 (e.g. set forth in SEQ ID NO: 356); a V germline segment that is an IGLV3 (e.g. set forth in SEQ ID NO: 400-417); and a J germline segment that is an IGLJ2 (e.g. set forth in SEQ ID NO: 443). Such antibodies also include any that are encoded by a sequence of nucleotides containing germline segments that are variants of any of the above germline segments, for example due to conservative mutations or other nucleotide mutations, so long as the resulting antibody is a functional and productive antibody and binds to EpoR and/or modulates a functional activity.

Exemplary of antibodies against EpoR include an antibody where the VH chain is encoded by a sequence of nucleotides compiled from a $V_H$ germline segment that is a IGHV1-46 (e.g.,IGHV1-46*01, IGHV1-46*02, IGHV1-46*03), an IGHV3-23 (e.g. IGHV3-23*01, IGHV3-23*02, IGHV3-23*03, IGHV3-23*04, IGHV3-23*05), an IGHV4-28 (e.g. IGHV4-28*01, IGHV4-28*02, IGHV4-28*03, IGHV4-28*04, IGHV4-28*05), or an IGHV4-31 (e.g. IGHV4-31*01, IGHV4-31*02, IGHV4-31*03; IGHV4-31*04, IGHV4-31*05, IGHV4-31*06, IGHV4-31*07, IGHV4-31*08, IGHV4-31*09, IGHV4-31*10); a $D_H$ germline segment that is a IGHD6-6 (e.g. IGHD6-6*01), an IGHD6-13 (e.g. IGHD6-13*01), an IGHD3-10 (e.g. IGHD3-10*01 or IGHD3-10*02), an IGHD7-27*01, an IGHD2-15*01, or an IGHD6-13*01; and a JH germline segment that is an IGHJ1*01, an IGHJ4 (e.g. IGHJ4*01, IGHJ4*02 or IGHJ4*03), an IGHJ5 (e.g. IGHJ5*01, IGHJ5*02), an IGHJ6 (e.g. IGHJ6*01, IGHJ6*02, IGHJ6*03, IGHJ6*04), or an IGHJ2*01, or any modified form thereof, for example, set forth in SEQ ID NOS: 3455. The VL chain is encoded by a sequence of nucleotides compiled from a V germline segment that is an IGKV4-1 (e.g. IGKV4-1*01), an IGKV3-15*01, an IGKV3-20 (e.g. IGKV3*01, IGKV3*02), an IGKV1-5 (e.g. IGKV1-5*01, IGKV1-5*02, IGKV1-5*03), an IGKV1-39*01, or an IGKV2D-40*01; a J germline segment that is a IGKJ1*01; a V germline segment that is an IGLV3-19*01; and a J germline segment that is an ILGJ2*01. Exemplary antibodies provided herein that modulate an activity of EpoR are set forth in Table 18I.

TABLE 18I

Anti-EpoR Antibodies

| Heavy Chain Germline Segments | SEQ ID NO nucleotide | SEQ ID NO Amino acid | Light Chain Germline Segments | SEQ ID NO nucleotide | SEQ ID NO Amino acid |
|---|---|---|---|---|---|
| IGHV1-46*01; IGHD3-10*01; IGHJ4*01 | 1093 | 1509 | IGKV4-1*01; IGKJ1*01 | 1422 | 1838 |
| IGHV1-46*01; IGHD6-6*01; IGHJ1*01 | 1097 | 1513 | IGKV4-1*01; IGKJ1*01 | 1422 | 1838 |
| IGHV1-46*01; IGHD6-13*01; IGHJ4*01 | 1096 | 1512 | IGKV4-1*01; IGKJ1*01 | 1422 | 1838 |
| IGHV4-28*01; IGHD7-27*01; IGHJ1*01 | 1343 | 1759 | IGKV3-15*01; IGKJ1*01 | 1427 | 1843 |
| IGHV4-31*02; IGHD7-27*01; IGHJ5*01 | 1353 | 1769 | IGKV3-15*01; IGKJ1*01 | 1427 | 1843 |
| IGHV1-46*01; IGHD7-27*01; IGHJ2*01 | 1098 | 1514 | IGKV3-20*01; IGKJ1*01 | 1417 | 1833 |
| IGHV1-46*01; IGHD2-15*01; IGHJ2*01 | 1092 | 1508 | IGKV3-15*01; IGKJ1*01 | 1427 | 1843 |
| IGHV1-46*01; IGHD6-13*01; IGHJ4*01 | 1096 | 1512 | IGKV3-15*01; IGKJ1*01 | 1427 | 1843 |
| IGHV1-46*01; IGHD6-13*01; IGHJ4*01 | 1096 | 1512 | IGKV3-20*01; IGKJ1*01 | 1417 | 1833 |
| IGHV1-46*01; IGHD2-15*01; IGHJ2*01 | 1092 | 1508 | IGKV1-5*01; IGKJ1*01 | 1425 | 1841 |
| IGHV1-46*01; IGHD3-10*01; IGHJ4*01 | 1093 | 1509 | IGKV2D-40*01; IGKJ1*01 | 1437 | 1853 |
| IGHV1-46*01; IGHD6-13*01; IGHJ4*01 | 1096 | 1512 | IGKV2D-40*01; IGKJ1*01 | 1437 | 1853 |
| IGHV3-23*01; IGHD3-10*01>3; IGHJ6*01 | 2669 | 3359 | IGKV1-39*01; IGKJ1*01 | 1438 | 1854 |
| IGHV3-23*01; IGHD3-10*01>3; IGHJ6*01 | 2669 | 3359 | IGLV3-19*01; IGLJ2*01 | 1454 | 1870 | viii. Cadherins

Cadherins are a class of calcium dependent, type-1 transmembrane glycoproteins that are involved in cell adhesion, helping to ensure that cells within tissues are bound together. There are multiple classes of cadherin molecules, including but not limited to N-cadherin, E-cadherin and P-cadherin. Members of this family exhibit calcium-dependent homophilic interactions and are responsible for the selective cell-cell recognition and adhesion, which is necessary for allocating different cell types to their proper places during organ development. Cadherins also play an important role in maintaining the integrity of multicellular structures. During embryonic morphogenesis the expression of diverse members of the cadherin family is spatially and temporally regulated facilitating the orderly assembly of various cell types into functional structures. Cadherins are considered to play a significant role in the cellular connections of cancer and metastatic cells.

a) P-Cadherin (P-cad/CDH3)

P-cadherin (P-cad; set forth in SEQ ID NO: 2008) is a single-span type-1 transmembrane glycoprotein found in the placenta that is homologous to E-cadherin (epithelial cadherin, E-cad). Both P-cad and E-cad interact with the cytoskeleton by alpha-catenin. Like other cadherins, p-cadherin plays a role in epithelial cell-cell adhesion. Other major roles include the determination of cell phenotypes and involvement in cell dynamics, including migration and the dissemination of tumor cells. The expression of P-cad in epithelial tissues appears to identify cell populations with proliferative activity, and its expression decreases as cells differentiate.

Expression of P-cadherin, a calcium-dependent cellular adhesion protein, has been reported in poorly differentiated and invasive bladder carcinoma cells. Such bladder carcinoma cells exhibit reduced E-cadherin expression. (Mialhe, A. et al., J. Urol. 164:826 (2000)). Down-regulation of E-cadherin and P-cadherin has also been associated with cultured neoplastic prostate cells. (Wang, J. et al., Urol. Res. 5:308 (2000)). The development of human colorectal cancer has been attributed, at least in part, to a decrease in cellular levels of the E-cadherin/catenin complex. (Debruyne, P. et al., Acta Gastroenterol. Belg. 62(4):393 (1999)). Aberrant up-regulation of P-cadherin was recently reported to be associated with proliferative cell phenotypes that can be related to neoplastic transformation of tissues of the gastrointestinal tract, particularly metaplastic and adenomatous polyps. (Sanders, D. S., et al., J. Pathol. 190(5):526 (2000)). Hence, certain cancer types, particularly some digestive cancer types, e.g., colon cancer, are characterized by the upregulation and the overexpression of P-cadherin relative to normal cells. P-cadherin is a valid target for cancer diagnosis, prophylaxis or therapy (see e.g. United States Published Patent Application No. 2003/0194406 and International Published Patent Application No. WO 02/097395).

Antibody libraries provided herein can be screened for modulation of an activity by assaying for binding to pCad and/or assaying for a functional activity. Assays for functional activity, include but are not limited to, assays that assess proliferation and/or adhesion of tumor cells, ADCC or CDC activity, anti-apoptotic assays, or cell cycle checkpoint assays. Example 13 exemplifies a binding assay to screen antibody libraries provided herein to select or identify antibodies that bind to pCad. Example 20 exemplifies an assay to assess effects of antibodies on cell to cell adhesion induced by p-cadherin. For example, an antibody that inhibits p-cadherin function can be identified based on the failure of cells to clump in the presence of the antibody.

The antibodies or portions thereof identified from the libraries provided herein that modulate an activity of pCad can be used for the treatment or prevention of disease states associated with expression and/or activity of pCad. For example, the antibodies or portions thereof can be used in the treatment of digestive cancers such as colon cancer, stomach cancer and liver cancer, and other cancers, such as lung cancer and breast cancer.

Provided herein are antibodies that modulate the activity of p-cadherin and therefore can be used in the treatment of diseases or conditions associated with expression or activity of p-cadherin. Such antibodies include those that have a VH chain and a VL chain encoded by a sequence of nucleotides compiled from germline segments, or any antibodies optimized therefrom. Exemplary of such antibodies are Fab antibodies. The antibodies further can contain a constant region. The antibodies include those that have a binding affinity for p-cadherin that is or is about $10^{-6}$M, $10^{-7}$M, $10^{-8}$M, $10^{-9}$M, $10^{-10}$M, $10^{-11}$M, $10^{-12}$M or lower, in particular any that have a nanomolar or sub-nanomolar binding affinity.

Anti-p-cadherin antibodies provided herein include antibodies having at least one CDR that is a CDRH1, CDRH2, CDRH3, CDRL1, CDRL2 and/or CDRL3. For example, a CDRH1 is GYTFTSYYMH (amino acids 26-35 of SEQ ID NO:1512); a CDRH1 is GFTFSSYAMS (amino acids 26-35 of SEQ ID NO:3559); a CDRH2 is IINPSGGSTSYAQKFQG (amino acids 50-66 of SEQ ID NO:1512); a CDRH2 is SISGSGGSTYYADSVKG (amino acids 50-66 of SEQ ID NO:3359); a CDRH3 is EGYSSSWYDYFDY (amino acids 99-111 of SEQ ID NO:1512); a CDRH3 is ANWGYWYFDL (amino acids 99-108 of SEQ ID NO:1514); a CDRH3 is EYYYGSGSYYNDYFDY (amino acids 99-114 of 1509); a CDRH3 is GITMVRGVIISYYYYYYGMDV (amino acids 99-119 of SEQ ID NO:3359); a CDRH3 is VIITPRTIVI-SYAFDV (amino acids 99-114 of SEQ ID NO:3071; a CDRL1 is RASQSVSSNLA (amino acids 24-35 of SEQ ID NO:1843); a CDRL1 is RASQSVSSSYLA (amino acids 24-35 of SEQ ID NO:1833); a CDRL1 is RASQSISSWLA (amino acids 24-34 of SEQ ID NO:1841); a CDRL1 is RASQSISSYLN (amino acids 24-34 of SEQ ID NO:1854); a CDRL1 is QGDSLRSYYAS (amino acids 23-33 of SEQ ID NO:1870; a CDRL2 is GASTRAT (amino acids 50-56 of SEQ ID NO:1843); a CDRL2 is GASSRAT (amino acids 51-57 of SEQ ID NO:1833); a CDRL2 is DASSLES (amino acids 50-56 of SEQ ID NO:1841); a CDRL2 is AASSLQS (amino acids 50-56 of SEQ ID NO:1854); a CDRL2 is GKN-NRPS (amino acids 49-55 of SEQ ID NO:1870); a CDRL3 is QQYNNWPPWT (amino acids 89-98 of SEQ ID NO:1843); a CDRL3 is QQYGSSPPWT (amino acids 90-99 of SEQ ID NO:1833); a CDRL3 is QQYNSYSPWT (amino acids 89-98 of SEQ ID NO:1841); a CDRL3 is QQSYSTPPWT (amino acids 89-98 of SEQ ID NO:1854); and a CDRL3 is NSRDSS-GNHLW (amino acids 88-99 of SEQ ID NO:1870). Also provided herein is a CDR that exhibits 60%, 65%, 70%, 80%, 90%, 91%, 92%, 93%, 94%, 95%, 96%, 97%, 98%, 99% or more sequence identity to any of the above CDRs.

For example, antibodies that modulate an activity of p-cadherin include any that contain a VH chain encoded by a sequence of nucleotides containing germline components compiled from a $V_H$ germline segment that is an IGHV1 (e.g. any set forth in any of SEQ ID NOS:1-43) or an IGHV3 (e.g. any set forth in any of SEQ ID NOS:68-152); a DH germline segment that is an IGHD3 (e.g. any set forth in SEQ ID NOS:252-259), an IGHD6 (e.g. any set forth in SEQ ID NOS: 268-271) or an IGHD7 (e.g. set forth in SEQ ID NO: 272); and a $J_H$ germline segment that is an IGHJ2 (e.g. set forth in SEQ ID NO:274), IGHJ3 (e.g. set forth in SEQ ID NO:275 or 276), is an IGHJ4 (e.g. set forth in SEQ ID NO: 278 or 279), an IGHJ6 (e.g. set forth in any of SEQ ID NOS: 282-285), or is a modified form of a JH germline segment, for example, set forth in any of SEQ ID NOS: 3450-3455. Such antibodies also include any that contain a VL chain encoded by a sequence of nucleotides containing germline components compiled from a V germline segment that is an IGKV1 (e.g. any set forth in SEQ ID NOS: 286-316), or an IGKV3 (e.g. any set forth in any of SEQ ID NOS:332-350); a J germline segment that is an IGKJ1 (e.g. set forth in SEQ ID NO: 356); a V germline segment that is an IGLV3 (e.g. set forth in SEQ ID NO: 400-417); and a J germline segment that is an IGLJ2 (e.g. set forth in SEQ ID NO: 443). Such antibodies also include any that are encoded by a sequence of nucleotides containing germline segments that are variants of any of the above germline segments, for example due to conservative mutations or other mutations, so long as the resulting antibody is a functional and productive antibody and binds to p-cadherin and/or modulates a functional activity.

Exemplary of antibodies against p-cadherin include an antibody where the VH chain is encoded by a sequence of nucleotides compiled from a $V_H$ germline segment that is a IGHV1-46 (e.g. an IGHV1-46*01, IGHV1-46*01, or an IGHV1-46*03) or an IGHV3-23 (e.g. IGHV3-23*01, IGHV3-23*02, IGHV3-3*03, IGHV3-23*04, IGHV3-23*05); a $D_H$ germline segment that is an IGHD3-10 (e.g. IGHD3-10*01, IGHD3-10*02) or an IGHD6-13 (e.g. IGHD6-13*01) or an IGHD7-27*01; and a JH germline segment that is an IGHJ3 (e.g. IGHJ3*01, IGHJ3*02), IGHJ4 (e.g. IGHJ4*01, IGHJ4*02, IGHJ4*03), an IGHJ6 (e.g. IGHJ6*01, IGHJ6*02, IGHJ6*03, IGHJ6*04), or an IGHJ2*01, or any modified form thereof, for example, set forth in SEQ ID NO: 3452 and 3455 and encoding a $J_H$ region set forth in SEQ ID NO:3458 and 3461, respectively. The VL chain is encoded by a sequence of nucleotides compiled from a V germline segment that is an IGKV1-5 (e.g. IGKV1-5*01, IGKV1-5*02, IGKV1-5*03), IGKV1-39*01, an IGKV3-15 (e.g. IGKV3-15*01), IGKV3-20 (e.g. IGKV3-20*01, IGKV3-20*02) or an IGKV3-11 (e.g. IGKV3-11*01, IGKV3-11*02); a J germline segment that is a IGKJ1*01; a V germline segment that is an IGLV3-19*01; and a J germline segment that is an ILGJ2*01. Exemplary antibodies provided herein that modulate an activity of p-cadherin are set forth in Table 18J.

TABLE 18J

Anti-p-cadherin Antibodies

| Heavy Chain Germline Segments or Modified forms thereof | SEQ ID NO | | Light Chain Germline Segments | SEQ ID NO | |
|---|---|---|---|---|---|
| | nucleotide | Amino acid | | nucleotide | Amino acid |
| IGHV1-46*01; IGHD6-13*01; IGHJ4*01 | 1096 | 1512 | IGKV3-15*01; IGKJ1*01 | 1427 | 1843 |
| IGHV1-46*01; IGHD6-13*01; IGHJ4*01 | 1096 | 1512 | IGKV3-20*01; IGKJ1*01 | 1417 | 1833 |

TABLE 18J-continued

Anti-p-cadherin Antibodies

| Heavy Chain Germline Segments or Modified forms thereof | SEQ ID NO | | Light Chain Germline Segments | SEQ ID NO | |
|---|---|---|---|---|---|
| | nucleotide | Amino acid | | nucleotide | Amino acid |
| IGHV1-46*01; IGHD7-27*01; IGHJ2*01 | 1098 | 1514 | IGKV3-11*01; IGKJ1*01 | 1434 | 1850 |
| IGHV1-46*01; IGHD3-10*01; IGHJ4*01 | 1093 | 1509 | IGKV1-5*01; IGKJ1*01 | 1425 | 1841 |
| IGHV3-23*01; IGHD3-10*01>3; IGHJ6*01 | 2669 | 3359 | IGKV1-39*01; IGKJ1*01 | 1438 | 1854 |
| IGHV3-23*01; IGHD3-10*01>1'; IGHJ3*01 | 2381 | 3071 | IGKV1-39*01; IGKJ1*01 | 1438 | 1854 |
| IGHV3-23*01; IGHD3-10*01>3; IGHJ6*01 | 2669 | 3359 | IGLV3-19*01; IGLJ2*01 | 1454 | 1870 | ix. CD44

CD44 (set forth in SEQ ID NO: 2006) is a cell-surface integral membrane glycoprotein involved in cell-to-cell interactions, cell adhesion and migration. Transcripts of the CD44 gene undergo complex alternative splicing resulting in many distinct functional isoform variants. CD44 is a protein which is expressed in several different isoforms on the surface of a wide variety of cell types. The smallest isoform, standard CD44 (CD44s), which is expressed by a variety of different cells, is thought to mediate cell attachment to extracellular matrix components and can transmit a co-stimulus in lymphocyte and monocyte activation. In contrast, expression of splice variants of CD44 which contain the domain v6 (CD44v6) in the extracellular region, is restricted to a subset of epithelia.

CD44 participates in a wide variety of cellular functions, including lymphocyte activation, recirculation and homing, hematopoiesis and tumor metastasis. CD44 is a receptor for hyaluronic acid and can also interact with other ligands such as E-selectin and L-selectin and other ligands such as osteopontin, collagens and matrix metalloproteinases (MMPs). MMPs degrade proteins that keep vessel walls solid allowing endothelial cells to escape into the interstitial matrix causing sprouting angiogenesis. Inhibition of MMPs prevents formation of new capillaries. Interactions of CD44 with hyaluronan mediates cell adhesion interactions. Treatments that disrupt such interactions can be used in the treatment of a number of pathologies.

Some CD44 variations are cell surface markers for breast and prostate cancer cells. Overexpression of CD44 has been linked to the growth and spread of a range of different types of malignancies, particularly lymphomas. CD44v6, as well as other variant exons (CD44v3, CD44v5, CD44v7/v8, CD44v10) has been shown to be a tumor-associated antigen with a favorable expression pattern in human tumors and normal tissues (Heider K H et al. Eur. J. Cancer 31A:2385-2391, 1995; Heider K H et al. Cancer Immunology Immunotherapy 43:245-253, 1996; Dall et al., 1996; Beham-Schmid et al., 1998; Tempfer et al., 1998; Wagner et al., 1998) and has been subject to antibody-based diagnostic and therapeutic approaches, in particular radioimmunotherapy (RIT) of tumors (Stroomer J W et al. Clin Cancer Res 6(8):3046-55, 2000, WO 95/33771, WO 97/21104). CD44 has been the target of the development of anti-cancer therapeutics (see e.g. U.S. Pat. No. 5,990,299).

Antibody libraries provided herein can be screened for modulation of an activity by assaying for binding to CD44 and/or assaying for a functional activity. Example 13 exemplifies a binding assay to screen antibody libraries provided herein to select or identify antibodies that bind to pCad.

The antibodies or portions thereof identified from the libraries provided herein that modulate an activity of CD44 can be used for the treatment or prevention of disease states associated with expression and/or activity of CD44 or a variant thereof. For example, the antibodies or portions thereof can be used in the treatment of a cancer that is a head and neck squamous cell carcinoma (SCC), esophagus SCC, lung SCC, skin SCC, breast adenocarcinoma (AC), lung AC, cervix SCC, pancreas AC, colon AC, or stomach AC. The antibodies or portions thereof also can be used in the treatment of rheumatoid arthritis.

4. Iterative Screening

Upon identification of a "Hit" the methods described in Section C can be repeated to generate a further library for use in the screening methods herein. By virtue of the fact that antibodies are provided in an addressable format, identification of a "Hit" permits instant identification and assessment of the "structure/activity" relationship. For example, upon identification of a "Hit" the component germline segments of the encoded antibody can be immediately envisaged. A subsequent library can be generated that includes antibodies encoded by nucleic acid molecules derived from germline segments "related" to the identified "Hit". Typically, the germline segments are related by sequence similarity, but can also be related by some other shared characteristic such as a CDR, directed peptide, or other biochemical attribute.

Generally, for the generation of a further antibody library in the iterative screening method, all gene families of the germline segments contained in a "Hit" are identified. All $V_H$, $D_H$ and $J_H$ gene family segments thereof are combined in all possible permutations, or a subset thereof as desired, to generate a recombined nucleic acid molecule encoding a VH chain. All $V_\kappa$ and $J_\kappa$, or $V_\lambda$ and $J_\lambda$ gene family segments thereof are combined in all possible permutation, or a subset thereof as desired, to generate a recombined nucleic acid molecule encoding a VL chain. Vectors and cells expressing the various paired VH and VL members, in all permutations, are generated, proteins expressed, and antibody members purified to generate a further antibody library. The further antibody library can be provided in an addressed format. The further library can be used in screening assays as described herein above to optimize the "Hit".

In addition, it is contemplated herein that because libraries can be created whereby the identify of each member is known, a library might exist already containing the exact desired "related" library members. Thus, those members can be collected to create a sub-library of related "Hits" for screening without having to reperform the method herein.

It also is contemplated that the "Hits" or any subsequent members of a further library can be mutagenized, such as by directed evolution, to further optimize the "Hit".

5. Directed Evolution

Antibody "Hits" identified by the screening methods herein can be further modified, e.g., by mutagenesis, to provide a library of modified antibodies. The modified antibodies are then evaluated to identify one or more antibodies which have altered functional properties (e.g., improved binding, improved stability, lengthened stability in vivo, and/or improved modulation of a functional activity). A further library of modified "Hits" can be generated to select or screen for an improved activity against a target protein. The library can be screened in an addressable format or other display format as described herein above. For example, higher affinity binding proteins can be identified from the second library, e.g., by using higher stringency or more competitive binding and washing conditions. Other screening techniques can also be used.

Various approaches have been used to create mutated antibody repertoires, including chain shuffling (Marks et al. (1992) Bio/Technology 10:779 and Clackson et al. (1991) Nature 352:624), error prone PCR (Hawkins et al. (1992) J. Mol. Biol. 226:889; and Leung et al. (1989) Technique 1:11-15), use of E. coli mutator strains (Low et al. (1996) J. Mol. Biol. 260,359), recombination (see, e.g., United States Publication No. 2004-0005709), DNA shuffling using random cleavage (Stemmer (1994) Nature 389-391; termed "nucleic acid shuffling"), RACHITT® (Coco et al. (2001) Nature Biotech. 19:354), or approaches more specifically directed to the complementarity determining regions (CDRs) of the antibody molecule, like CDR walking (Barbas et al. (1994) Proc. Natl. Acad. Sci. USA 91:3809 and Yang et al. (1995) J. Mol. Biol. 254:392), site-directed mutagenesis (Zoller et al. (1987) Nucl Acids Res 10:6487-6504), cassette mutagenesis (Reidhaar-Olson (1991) Methods Enzymol. 208:564-586) and incorporation of degenerate oligonucleotides (Griffiths et al. (1994) EMBO J 13:3245).

In some implementations, the mutagenesis is targeted to regions known or likely to be at the binding interface. For example, mutagenesis can be directed to the CDR regions of the heavy or light chains as described herein. Further, mutagenesis can be directed to framework regions near or adjacent to the CDRs, e.g., framework regions, particular within ten, five, or three amino acids of a CDR junction. Additionally, mutagenesis can also be limited to one or a few of the CDRs, e.g., to make step-wise improvements.

a. Random Mutagenesis

Antibodies bind to antigens via residues in their CDRs. Consequently, mutagenesis of CDRs is widely used to improve the affinity of Fab and Fv fragments of antibodies. Random mutagenesis methods include, for example, use of E. coli XL1red, UV irradiation, chemical modification such as by deamination, alkylation, or base analog mutagens, or PCR methods such as DNA shuffling, cassette mutagenesis, site-directed random mutagenesis, error prone PCR (see e.g. U.S. Application No.: 2006-0115874) or the use of commercially available random mutagenesis kits such as, for example, GeneMorph PCR-based random mutagenesis kits (Stratagene) or Diversify random mutagenesis kits (Clontech). The Diversify random mutagenesis kit allows the selection of a desired mutation rate for a given DNA sequence (from 2 to 8 mutations/1000 base pairs) by varying the amounts of manganese ($Mn^{2+}$) and dGTP in the reaction mixture. Raising manganese levels initially increases the mutation rate, with a further mutation rate increase provided by increased concentration of dGTP. Even higher rates of mutation can be achieved by performing additional rounds of PCR. All of these approaches involve the construction of expression libraries of antibodies with mutations in the CDRs and selection for better binders. Any of a variety of general approaches for directed protein evolution based on mutagenesis can be employed. Any of these, alone or in combination can be used to modify a lead antibody to achieve a desired property. Any method known in the art can be used to modify or alter a lead antibody.

i. Saturation Mutagenesis

In one exemplary embodiment, a saturation mutagenesis technique is used in which the CDR residue(s) are mutated to each of the 20 possible amino acids (see e.g., the Kunkle method, Current Protocols in Molecular Biology, John Wiley and Sons, Inc., Media Pa. and U.S. Pat. No. 6,562,594). In such a technique, a degenerate mutagenic oligonucleotide primer can be synthesized which contains randomization of nucleotides at the desired codon(s) encoding the selected amino acid(s). Exemplary randomization schemes include NNS- or NNK-randomization, where N represents any nucleotide, S represents guanine or cytosine and K represents guanine or thymine. The degenerate mutagenic primer is annealed to the single stranded DNA template and DNA polymerase is added to synthesize the complementary strand of the template. After ligation, the double stranded DNA template is transformed into E. coli for amplification. Alternatively, single amino acid changes are made using standard, commercially available site-directed mutagenesis kits such as QuikChange (Stratagene). In another embodiment, any method commonly known in the art for site specific amino acid mutation can be used.

ii. Error Prone PCR

Error prone PCR can introduce random mutations into nucleic acid sequences (See, e.g., Hawkins et al. (1992) J. Mol. Biol. 226(3):889-96). Briefly, PCR is run under conditions which compromise the fidelity of replication, thus introducing random mutations in sequences as those skilled in the art can accomplish. After generation of such random mutants, they can be placed into genetic display formats, panned and thus evaluated for activity.

iii. Cell Lines

A mutator strain of bacteria, such as E. coli mutD5 or Epicurian Cole XL1-Red Competent cells (Stratagene, La Jolla, Calif.), can be used during plasmid replication to generate a repertoire of antibodies that include single nucleotide point mutations. The libraries of random mutants are then screened for biological activity using a genetic display format.

iv. DNA Shuffling/Antibody Chain Shuffling

DNA shuffling can be employed to modulate the activities of lead antibodies. In DNA shuffling, variant DNA molecules are generated by in vitro homologous recombination by random fragmentation of a parent DNA followed by reassembly using PCR, resulting in randomly introduced point mutations (see e.g. Stemmer, (1994) Nature 370:389-391; Stemmer (1994) Proc. Natl Acad. Sci. USA 91:10747-10751; U.S. Pat. Nos. 5,605,793, 5,811,238, and 5,830,721; and International Publication Nos. WO 95/022625 and WO 97/20078).

This technique can be modified by using a family of parent DNA molecules, such as allelic variants or DNA molecules from different species, to introduce additional variability into the process. Selection or screening for the desired activity, followed by additional iterations of mutagenesis and assay provides for rapid "evolution" of sequences by selecting for desirable mutations while simultaneously selecting against detrimental changes.

In antibody chain shuffling, one selected VH sequence is paired with variety of VL sequences to create new VH/VL partners (see e.g. Kang et al. (1991) *Proc. Natl. Acad. Sci. USA* 88:11120 11123; Collet et al. (1992) *Proc. Natl. Acad. Sci. USA* 89:10026-10030; and Marks et al. (1992) *Bio/Technology* 10:779)

v. CDR Walking

In another example, the generation or selection of higher affinity antibodies can be carried out by CDR walking mutagenesis, which mimics the tertiary immune selection process. For example, saturation mutagenesis of the CDR's of an antibody can be used to generate one or more libraries of antibody fragments which are displayed on the surface of filamentous bacteriophage followed by the subsequent selection of the relevant antibody using immobilized antigen. Sequential and parallel optimization strategies can be used to then select the higher affinity antibody (see e.g. Barbas et al. (1994) *Proc. Natl. Acad. Sci. USA* 91:3809-3813; and Yang et al. (1995) *J. Mol. Biol* 254(3):392-403).

vi. Framework Stabilization

A mutation can be made in a framework region or constant domain to increase the half-life of the antibody. A mutation in a framework region or constant domain also can be made to alter the immunogenicity of the antibody, to provide a site for covalent or non-covalent binding to another molecule, or to alter such properties as complement fixation, FcR binding and antibody-dependent cell-mediated cytotoxicity (ADCC). A single antibody can have mutations in any one or more of the CDRs or framework regions of the variable domain or in the constant domain. See, e.g., PCT Publication No. WO 00/09560; Ewert et al. (2003) *Biochemistry* 42(6):1517-1528; Ewert et al. (2004) *Methods* 23(2):184-99; and Knappik et al. (1995) *Protein Engineering* 8:81-89.

6. Epitope Mapping

Once a "Hit" is identified its binding epitope can be determined. Hence, antibody libraries provided herein can be used to identify novel epitopes, including but not limited to, previously unidentified epitopes on known antigens or novel epitopes of unknown antigens, for example, those presented by a carcinoma cell line. Methods of epitope mapping are known to one skill in the art (see e.g., Olwyn M. R. Westwood and Frank C. Hay. Epitope Mapping. Oxford University Press, 2001; Sigma Catalog #Z373990 Epitope Mapping Protocols: Methods in Molecular Biology, Vol. 66). Methods for mapping of epitopes recognized by an antibody include, but are not limited to, binding assays such as by using BIAcore or ELISA (Reineke et al. 1999), ELISPOT, prediction software, combinatorial synthesis of peptide libraries onto a planar support (i.e. protein chip) followed by exposure of the surface to the antibody, phage display of a library of peptides derived from the sequence of the protein antigen, methods using mass spectrometry methods such as methods using MALDI or amide H/D exchange (see e.g. Baerga-Ortiz et al. (2002) Protein Science, 11:1300-1308) and surface plasma resonance.

7. In Vivo Assays of Identified Hits

Once a "Hit" is identified against a target of interest, it can be assessed in vivo assays associated with aberrant activity of the target. In general, the method involves administering an antibody to a subject, generally a non-human animal model for a disease or condition and determining the effect of the antibody on the on the disease or condition of the model animal. In vivo assays include controls, where suitable controls include a sample in the absence of the antibody. Generally a plurality of assay mixtures is run in parallel with different antibody concentrations to obtain a differential response to the various concentrations. Typically, one of these concentrations serves as a negative control, i.e. at zero concentration or below the level of detection. An antibody of interest is one that modulates, i.e., reduces or increases a symptom of the animal model disease or condition by at least about 10%, at least about 20%, at least about 25%, at least about 30%, at least about 35%, at least about 40%, at least about 45%, at least about 50%, at least about 55%, at least about 60%, at least about 65%, at least about 70%, at least about 80%, at least about 90%, or more, when compared to a control in the absence of the antibody. In general, an antibody of interest will cause a subject animal to be more similar to an equivalent animal that is not suffering from the disease or condition.

Non-human animals models include those induced to have a disease such as by injection with disease and/or phenotype-inducing substances prior to administration of the antibodies to monitor the effects on disease progression. Genetic models also are useful. Animals, such as mice, can be generated which mimic a disease or condition by the overexpression, underexpression or knock-out of one or more genes. Such animals can be generated by transgenic animal production techniques well-known in the art or using naturally-occurring or induced mutant strains. One of skill in the art is familiar with various animal models associated with particular targets.

Such animal model systems include, but are not limited to, mice, rats, rabbits, guinea pigs, sheep, goats, pigs, and non-human primates, e.g. baboons, chimpanzees and monkey. Any animal system well-known in the art can be used. Several aspects of the procedure can vary; said aspects include, but are not limited to, the temporal regime of administering the antibodies (e.g., prophylactic and/or therapeutic agents), whether such antibodies are administered separately or as an admixture, and the frequency of administration of the antibodies.

Recombinant (transgenic) animal models can be engineered by introducing the coding portion of the genes identified herein into the genome of animals of interest, using standard techniques for producing transgenic animals. Animals that can serve as a target for transgenic manipulation include, without limitation, mice, rats, rabbits, guinea pigs, sheep, goats, pigs, and non-human primates, e.g. baboons, chimpanzees and monkeys. Techniques known in the art to introduce a transgene into such animals include pronucleic microinjection (U.S. Pat. No. 4,873,191); retrovirus-mediated gene transfer into germ lines (e.g., Van der Putten et al., (1985) *Proc. Natl. Acad. Sci. USA* 82:6148-615); gene targeting in embryonic stem cells (Thompson et al., (1989) *Cell* 56:313-321); electroporation of embryos (Lo, (1983) *Mol. Cel. Biol.* 3:1803-1814); sperm-mediated gene transfer (Lavitrano et al., (1989) *Cell* 57:717-73). For review, see, for example, U.S. Pat. No. 4,736,866.

Animal models can be used to assess the efficacy of an antibody, a composition, or a combination therapy provided herein. Examples of animal models for lung cancer include, but are not limited to, lung cancer animal models (see e.g. Zhang et al., (1994) *In Vivo* 8(5):755-69) and a transgenic mouse model with disrupted p53 function (see, e.g., Morris et al., (1998) *J La State Med Soc* 150(4):179-85). An example of an animal model for breast cancer includes, but is not limited to, a transgenic mouse that overexpresses cyclin D1 (see, e.g., Hosokawa et al., (2001) *Transgenic Res* 10(5):471-8). An example of an animal model for colon cancer includes, but is not limited to, a TCR b and p53 double knockout mouse (see, e.g., Kado et al. (2001), *Cancer Res* 61(6):2395-8). Examples of animal models for pancreatic cancer include, but are not limited to, a metastatic model of Panc02 murine pancreatic adenocarcinoma (see, e.g., Wang et al. (2001) *Int J Pancreatol*

29(1):37-46) and nu-nu mice generated in subcutaneous pancreatic tumors (see, e.g., Ghaneh et al., (2001) *Gene Ther* 8(3):199-208). Examples of animal models for non-Hodgkin's lymphoma include, but are not limited to, a severe combined immunodeficiency ("SCID") mouse (see, e.g., Bryant et al. (2000) *Lab Invest* 80(4):553-73) and an IgHmu-HOX11 transgenic mouse (see, e.g., Hough et al. (1998) *Proc Natl Acad Sci USA* 95(23):13853-8). An example of an animal model for esophageal cancer includes, but is not limited to, a mouse transgenic for the human papillomavirus type 16 E7 oncogene (see, e.g., Herber et al., (1996) *J Virol* 70(3): 1873-81). Examples of animal models for colorectal carcinomas include, but are not limited to, Apc mouse models (see, e.g., Fodde & Smits, (2001) *Trends Mol Med* 7(8):369-73 and Kuraguchi et al., (2000) *Oncogene* 19(50):5755-63).

Animal models for arthritis include, but are not limited to, rheumatoid arthritis rats (see e.g. Pearson, (1956) *Proc. Soc. Exp. Biol. Med.*, 91:95-101) and collagen induced arthritis in mice and rats (see e.g. Current Protocols in Immunology, Eds. J. E. Cologan, A. M. Kruisbeek, D. H. Margulies, E. M. Shevach and W. Strober, John Wiley & Sons, Inc., 1994). An example of an animal model for asthma, includes but is not limited to, a mouse model of pulmonary hypersensitivity (see e.g. Riese et al. (1998) *J. Clin. Invest.* 101:2351-2363 and Shi, et al. (1999) *Immunity* 10:197-206). Animal models for allogenic rejection include, but are not limited to, rat allogeneic heart transplant models (see e.g. Tanabe et al. (1994) *Transplantation* 58:23-27 and Tinubu et al. (1994) *J. Immunol.* 153:4330-4338) and rat heterocardiac allograft rejection (Jae-Hyuck Sim et al. (2002) *Proc Natl Acad Sci U.S.A.* 99(16):10617-10622). Steel mice are used as a model of human aplastic anemia (see e.g. Jones, (1983) *Exp. Hematol.*, 11:571-580). An example of an animal model for anemia, includes but is not limited to, hemolytic anemia guinea pigs (see e.g. Schreiber, et al. (1972) *J. Clin. Invest.* 51:575). An example of an animal model for neutropenia, includes but is not limited to, neutropenia neutropenic CD rats (see, e.g. Nohynek et al. (1997) *Cancer Chemother. Pharmacol.* 39:259-266).

8. Articles of Manufacture/Kits

Pharmaceutical compounds of selected antibodies or nucleic acids encoding selected antibodies, or a derivative or a biologically active portion thereof can be packaged as articles of manufacture containing packaging material, a pharmaceutical composition which is effective for treating the disease or disorder, and a label that indicates that selected antibody or nucleic acid molecule is to be used for treating the disease or disorder.

The articles of manufacture provided herein contain packaging materials. Packaging materials for use in packaging pharmaceutical products are well known to those of skill in the art. See, for example, U.S. Pat. Nos. 5,323,907, 5,052,558 and 5,033,252, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. A wide array of formulations of the compounds and compositions provided herein are contemplated as are a variety of treatments for any EPO-mediated disease or disorder or therapeutic polypeptide-mediated disease or disorder.

Antibodies and nucleic acid molecules encoding the antibodies thereof also can be provided as kits. Kits can include a pharmaceutical composition described herein and an item for administration. For example, a selected antibody can be supplied with a device for administration, such as a syringe, an inhaler, a dosage cup, a dropper, or an applicator. The kit can, optionally, include instructions for application including dosages, dosing regimens and instructions for modes of administration. Kits also can include a pharmaceutical composition described herein and an item for diagnosis. For example, such kits can include an item for measuring the concentration, amount or activity of the antibody in a subject.

9. Formulations/Administration and Uses of Antibodies and Polypeptides

The antibodies provided herein can be provided as a formulation for administration. While it is possible for the active ingredient to be administered alone, it is preferable to present it as a pharmaceutical formulation. Formulations contain at least one active ingredient, together with one or more acceptable carriers thereof. Each carrier must be both pharmaceutically and physiologically acceptable in the sense of being compatible with the other ingredients and not injurious to the patient. Formulations include those suitable for oral, rectal, nasal, or parenteral (including subcutaneous, intramuscular, intravenous and intradermal) administration. The formulations can conveniently be presented in unit dosage form and can be prepared by methods well known in the art of pharmacy. See, e.g., Gilman, et al. (eds. 1990) Goodman and Gilman's: The Pharmacological Bases of Therapeutics, 8th Ed., Pergamon Press; and Remington's Pharmaceutical Sciences, 17th ed. (1990), Mack Publishing Co., Easton, Pa.; Avis, et al. (eds. 1993) Pharmaceutical Dosage Forms: Parenteral Medications Dekker, N.Y.; Lieberman, et al. (eds. 1990) Pharmaceutical Dosage Forms: Tablets Dekker, N.Y.; and Lieberman, et al. (eds. 1990) Pharmaceutical Dosage Forms: Disperse Systems Dekker, N.Y.

The route of antibody administration is in accord with known methods, e.g., injection or infusion by intravenous, intraperitoneal, intracerebral, intramuscular, subcutaneous, intraocular, intraarterial, intrathecal, inhalation or intralesional routes, topical or by sustained release systems as noted below. The antibody is preferably administered continuously by infusion or by bolus injection. One can administer the antibodies in a local or systemic manner.

The antibodies provided herein can be prepared in a mixture with a pharmaceutically acceptable carrier. Techniques for formulation and administration of the compounds of the instant application can be found in "Remington's Pharmaceutical Sciences," Mack Publishing Co., Easton, Pa., latest edition. This therapeutic composition can be administered intravenously or through the nose or lung, preferably as a liquid or powder aerosol (lyophilized). The composition also can be administered parenterally or subcutaneously as desired. When administered systematically, the therapeutic composition should be sterile, pyrogen-free and in a parenterally acceptable solution having due regard for pH, isotonicity, and stability. These conditions are known to those skilled in the art.

Therapeutic formulations can be administered in many conventional dosage formulations. Briefly, dosage formulations of the antibodies provided herein are prepared for storage or administration by mixing the compound having the desired degree of purity with physiologically acceptable carriers, excipients, or stabilizers. Such materials are non-toxic to the recipients at the dosages and concentrations employed, and can include buffers such as TRIS HCl, phosphate, citrate, acetate and other organic acid salts; antioxidants such as ascorbic acid; low molecular weight (less than about ten residues) peptides such as polyarginine, proteins, such as serum albumin, gelatin, or immunoglobulins; hydrophilic polymers such as polyvinylpyrrolidinone; amino acids such as glycine, glutamic acid, aspartic acid, or arginine; monosaccharides, disaccharides, and other carbohydrates including cellulose or its derivatives, glucose, mannose, or dextrins; chelating agents such as EDTA; sugar alcohols such as mannitol or sorbitol; counterions such as sodium and/or nonionic surfactants such as TWEEN, PLURONICS or polyethyleneglycol.

When used for in vivo administration, the antibody formulation must be sterile and can be formulated according to conventional pharmaceutical practice. This is readily accomplished by filtration through sterile filtration membranes, prior to or following lyophilization and reconstitution. The antibody ordinarily will be stored in lyophilized form or in solution. Other vehicles such as naturally occurring vegetable oil like sesame, peanut, or cottonseed oil or a synthetic fatty vehicle like ethyl oleate or the like can be desired. Buffers, preservatives, antioxidants and the like can be incorporated according to accepted pharmaceutical practice.

Pharmaceutical compositions suitable for use include compositions wherein one or more rationally designed antibodies are contained in an amount effective to achieve their intended purpose. Determination of a therapeutically effective amount is well within the capability of those skilled in the art, especially in light of the detailed disclosure provided herein. Therapeutically effective dosages can be determined by using in vitro and in vivo methods.

An effective amount of antibody to be employed therapeutically will depend, for example, upon the therapeutic objectives, the route of administration, and the condition of the patient. In addition, the attending physician takes into consideration various factors known to modify the action of drugs including severity and type of disease, body weight, sex, diet, time and route of administration, other medications and other relevant clinical factors. Accordingly, it will be necessary for the therapist to titer the dosage and modify the route of administration as required to obtain the optimal therapeutic effect. Typically, the clinician will administer antibody until a dosage is reached that achieves the desired effect. The progress of this therapy is easily monitored by conventional assays.

For any antibody containing a peptide, the therapeutically effective dose can be estimated initially from cell culture assays. For example, a dose can be formulated in animal models to achieve a circulating concentration range that includes the EC50 as determined in cell culture (e.g., the concentration of the test molecule which promotes or inhibits cellular proliferation or differentiation). Such information can be used to more accurately determine useful doses in humans.

Toxicity and therapeutic efficacy of the antibody molecules described herein can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio between LD50 and ED50. Molecules which exhibit high therapeutic indices are preferred. The data obtained from these cell culture assays and animal studies can be used in formulating a range of dosage for use in human. The dosage of such molecules lies within a range of circulating concentrations that include the ED50 with little or no toxicity. The dosage can vary within this range depending upon the dosage form employed and the route of administration utilized. The exact formulation, route of administration and dosage can be chosen by the individual physician in view of the patient's condition. (See e.g., Fingl et al. 1975, in "The Pharmacological Basis of Therapeutics", Ch. 1, p. 1).

Dosage amount and interval can be adjusted individually to provide plasma levels of the antibody which are sufficient to promote or inhibit cellular proliferation or differentiation or minimal effective concentration (MEC). The MEC will vary for each antibody, but can be estimated from in vitro data using described assays. Dosages necessary to achieve the MEC will depend on individual characteristics and route of administration. However, HPLC assays or bioassays can be used to determine plasma concentrations.

Dosage intervals can also be determined using MEC value. Antibody molecules should be administered using a regimen which maintains plasma levels above the MEC for 10-90% of the time, typically between 30-90% and most typically between 50-90%.

In cases of local administration or selective uptake, the effective local concentration of the antibody can not be related to plasma concentration.

A typical daily dosage might range from about 1 /kg to up to 1000 mg/kg or more, depending on the factors mentioned above. Typically, the clinician will administer the molecule until a dosage is reached that achieves the desired effect. The progress of this therapy is easily monitored by conventional assays.

Depending on the type and severity of the disease, from about 0.001 mg/kg to abut 1000 mg/kg, more typically about 0.01 mg to 100 mg/kg, more typically about 0.010 to 20 mg/kg of the antibody, for example an antagonist or agonist antibody, is an initial candidate dosage for administration to the patient, whether, for example, by one or more separate administrations, or by continuous infusion. For repeated administrations over several days or longer, depending on the condition, the treatment is repeated until a desired suppression of disease symptoms occurs or the desired improvement in the patient's condition is achieved. However, other dosage regimes also are contemplated.

H. EXAMPLES

The following examples are included for illustrative purposes only and are not intended to limit the scope of the invention.

Example 1

Materials and Methods

1. Plasmids A and C

Plasmid A (SEQ ID NO:1), Plasmid C (SEQ ID NO:3), Plasmid D (SEQ ID NO:2) and Plasmid E (SEQ ID NO:4), set forth in FIGS. 3-6, are used to produce recombinant Fab antibodies. They contain high-copy, ColE1 replication origins that are compatible with *E. coli*. In addition, the ColE1 replication origins of plasmids A and D are compatible with the replication origins of plasmids C and E. Moreover, they replicate at similar copy numbers when co-cultured in the same *E. coli* cell. The plasmids contain a STII leader sequence that allows for the Fab to be translocated to the periplasm, to allow for better folding, and an Ara promoter for arabinose inducible gene expression. Plasmid A contains a heavy chain constant region for production of a Fab heavy chain and includes Flag and His tags for protein purification. Plasmid D contains a heavy chain constant region for production of a Fab heavy chain, and includes Flag, LPETG, and His tags for both protein purification and site specific modification using the protein ligase, sortase. Plasmid C contains a kappa light chain constant region for production of a kappa Fab light chain while Plasmid E contains a lambda light chain constant region for production of a lambda Fab light chain.

Thus Plasmids A and D encode Fab heavy chain and Plasmids C and E encode Fab light chain. A Fab is produced upon co-transformation of *E. coli* with a plasmid encoding a heavy chain and a plasmid encoding a light chain, and induction of the promoter to express the heavy or light chain genes.

2. Cell Lines

*E. coli* strains BL21 (EMD Biosciences) and LMG194 (ATCC) were used for expression of the Fabs. Ramos B-Lymphocyte cells (ATCC) and Jurkat T-Lymphocyte cells (ATCC) were used for the Apo-ONE homogenous Caspase-3/7 Assay. The BaF3 mouse peripheral blood cell line (Harvey Lodish, Massachusetts Institute of Technology) was used for the EPO Fab library cell based assays.

3. DNA Sequence Compilation Software

The DNA Sequence Compilation Software is provided herein. It implements an in silico method for recombining heavy chain V, D, and J segment sequences and recombining light chain V and J segments while maintaining functional germline antibody sequences. The software systematically combines DNA encoding the $V_H$, $D_H$ and $J_H$ and $V_L$ and $J_L$ germline segment sequences, or alternatively a subset of $V_H$, $D_H$ and $J_H$ and $V_L$ and $J_L$ germline segment sequences, to produce sequences of recombined heavy chain and light chain variable regions from which nucleic acid molecules are produced for production of a Fab library. The germline segment sequences are inputted from a database. Example 2 provides a description of the software. Example 3 describes how to use the software, and Example 4 describes implementation of the software to compile recombined germline sequences and output the sequences for DNA synthesis.

4. Piccolo™ Automated System

Piccolo™ system is a fully automated system for the rapid optimization of recombinant protein production, sold by The Automation Partnership (TAP) (see e.g., Wollerton et al. (2006) JALA, 11:291-303, which describes the system). The system combines cell culture with automated harvesting, lysis, and purification units. Example 9 provides details about the specifics of the Piccolo™ system operation.

Example 2

DNA Sequence Compilation Software Design

This example describes the DNA Sequence Compilation Software.

A. General Description:

Sequences for $V_H$, $D_H$ and $J_H$ and $V_L$ and $J_L$ germline segment sequences are inputted from a database file, i.e. SequenceDatabase.txt file described in detail below. The software 1) generates every possible recombination of $V_H$, $D_H$ and $J_H$ and $V_L$ and $J_L$ germline segments to generate sequences encoding a variable heavy (VH) chain and sequences encoding a variable light (VL) chain; 2) translates and frame-checks the sequences; 3) stores the sequences in a SequenceHistory.txt file to keep track of sequences in nucleotide format; and 4) outputs sequences as files that represent 96-well plates for ordering for DNA synthesis. Output is generated in the form of a 96-well plate file that lists the distinct heavy chain or light chain sequences as an array designating each locus in the array corresponding to a well in a 96-well plate. DNA molecules can be synthesized in a 96-well plate based on this output. In addition, the software can rank the sequences and generate diversity scores. The software automatically generates all permutions of recombined nucleic acid sequences encoding VH chains and VL chains (kappa and lambda). If desired, the output file can be manually restricted by the user by selecting germline segments to be recombined by the software, or by choosing sequences that are sufficiently diverse from one another using the ranking function.

Figure 7:
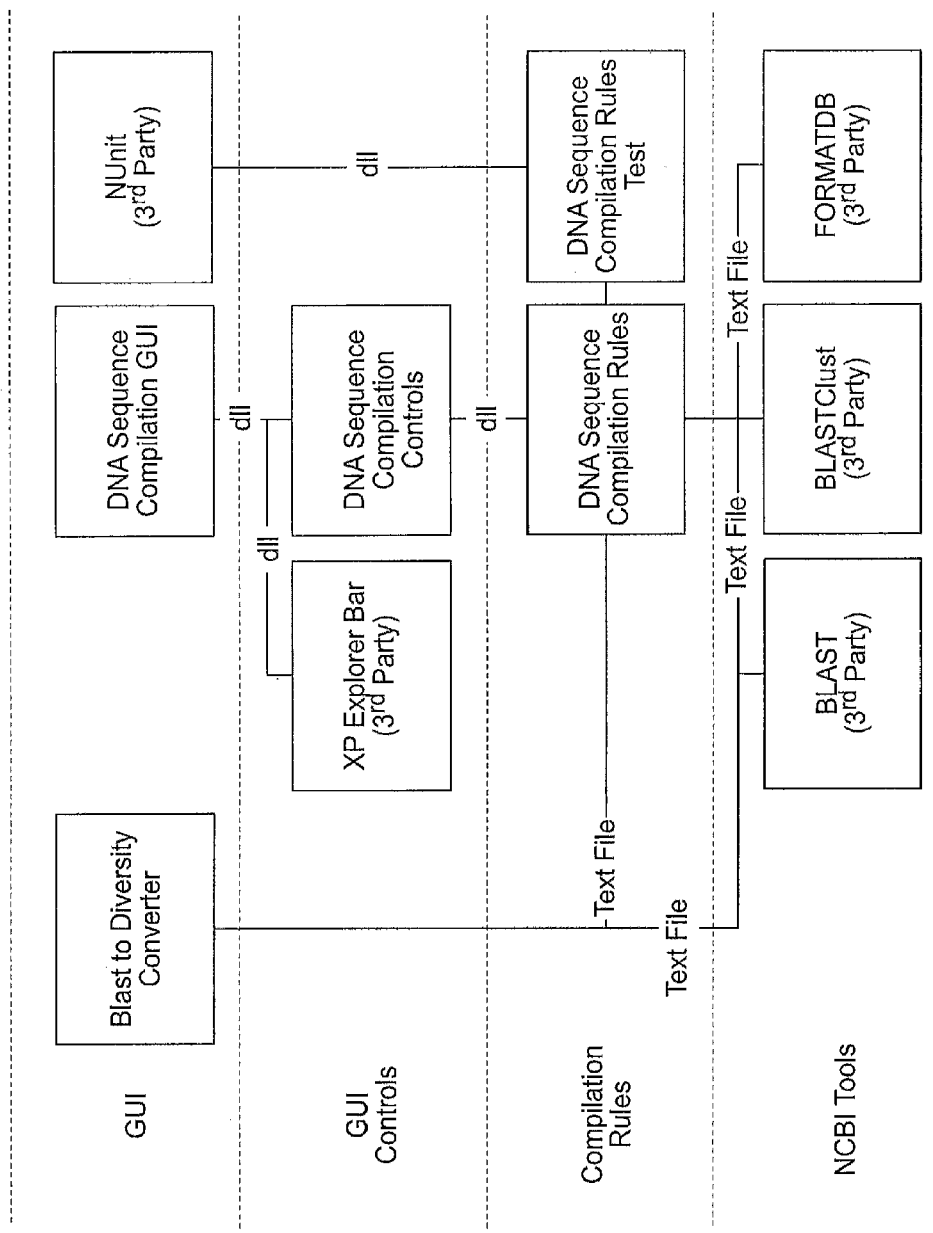
FIG. 7: Schematic Illustration of DNA Sequence Compilation Software Modules

B. Software Description:

The DNA Sequence Compilation Software was written in the C# programming language using the Visual Studio 2005 Professional Edition development tool. The DNA Sequence compilation Software require the Microsoft .NET framework 2.0 to run under the Windows XP and Vista 32-bit Edition Operating System. The software is composed of ten modules (see FIG. 7.) These modules include (a) Blast to Diversity Converter; (b) DNA Sequence Compilation GUI; (c) DNA Sequence Compilation Controls; (d) DNA Sequence Compilation Rules; and (e) DNA Sequence Compilation Rules Test, which are provided herein. The remaining five modules are available from public domain software. They include (f) NUnit; (g) formatdb; (h) BLAST; (i) BLASTClust; and (j) XP Explorer Bar.

The modules contain classes. A class is the formal definition of an object. The class acts as the template from which an instance of an object is created at run time. The class defines the properties of the object and the methods used to control the object's behavior. A singleton class is a class that is globally available to be accessed by all other classes. In this case the singleton class is the sequence compiler module, which has every rule for sequence compilation. A static class contains data and functions that can be accessed without creating an instance of the class. Static class members can be used to separate data and behavior that is independent of any object identity; the data and functions do not change regardless of what happens to the object.

Additionally, the software is grouped into 4 layers: 1) the graphical user interface (GUI); 2) GUI controls; 3) Compilation rules; and 4) NCBI tools. The 4 layers are:

GUI—The GUI is the presentation of information to and interaction with the computer operator. The GUI is made up of the Blast to Diversity Converter, the DNA Sequence Compilation GUI and NUnit.

GUI controls—Custom visible Windows controls that are re-used by the GUI. GUI controls is made up of the XP Explorer Bar and the DNA Sequence Compilation Controls.

Compilation Rules—Implementation of the rules for DNA sequence compilation. The compilation rules are made up of DNA Sequence Compilation Rules and DNA Sequence Compilation Rules Test.

NCBI tools—A set of tools available from NCBI that allows the user to run searches on a local computer.

1. Modules a. DNA Sequence Compilation GUI

DNA Sequence Compilation GUI is the main application. It interacts with the user and enables all the functionality to be available to the user. As a whole, the DNA Sequence Compilation GUI permits the user to selectively restrict germline segments to compile a sequence; automatically compile all sequences; automatically rank all the sequences in terms of sequence diversity, clusters or similarity; and select compiled DNA sequences to be placed in a 96-well plate.

The DNA Sequence Compilation GUI contains the following classes:

Program—a static class automatically generated that contains the execution entry point to the application;

SplashScreen—a user control that displays a splash screen when the application starts and exits;

MainForm—a form that encapsulates all the functionality that is available to the user. The MainForm also displays the user controls that are implemented in the DNA Sequence Compilation Controls module and initializes the SequenceCompiler singleton defined in the DNA Sequence Compilation Rules module;

Resources—a resource file containing the image for the splash screen;

Settings—an automatically generated class that contains the user settings for the 5' restriction site and 3' restriction site to be placed with the sequence for the IDT order; and AboutBox—a form that displays the application information to the user. It interacts with the user and enables all the functionality to be available to the user.

b. DNA Sequence Compilation Controls

The DNA Sequence Compilation Controls module contains custom window controls to be used by the DNA Sequence Compilation GUI. It contains the following classes:

FabrusDataGridView—a derived class of .NET framework DataGridView that displays the row number in the row header. A .NET framework is part of windows operating systems that contains a large library of pre-coded solutions to common programming problems and manages the execution of programs written specifically for the framework. The DataGridView control provides a customizable table for displaying data.

WellPlateControl—a custom control that displays 96-well plate information;

AutoHeavySequenceControl—a custom control that displays all of the automatically compiled DNA sequences in a data grid view for user selection into the 96-well plate, while also displaying rank, diversity score, cluster, V(D)J sequence identifier and DNA sequence protein sequence;

AutoLightSequenceControl—a custom control that displays all the automatically compiled DNA sequences in a data grid view for user selection into the 96-well plate, while also displaying rank, diversity score, cluster, V(D)J sequence identifier and DNA sequence protein sequence;

ManualHeavySequenceControl—a custom control that allows the user to manually select a $V_H$, $D_H$ and $J_H$ sequence with which to compile into a DNA heavy chain sequence;

ManualLightSequenceControl—a custom control that allows the user to manually select a $V_L$ and $J_L$ sequence with which to compile into a DNA light chain sequence;

LightSequenceBlastForm—a custom control that displays in grid format the BLAST results of a light sequence against all other light chains; and HeavySequenceBlastForm—a custom control that displays in grid format the BLAST results of a heavy chain sequence against all the other heavy chains.

c. DNA Sequence Compilation Rules Module

The DNA Sequence Compilation Rules module contains all of the business logic for the compilation of the DNA sequences. This module includes all the rules for compiling functional recombed VDJ and VJ antibody sequences, including compilation, joint generation, stop codon removal, and sequence ranking.

There are six main classes within the DNA Sequence Compilation Module:

SequenceCompiler is a singleton class that provides all the DNA sequence compilation functionality. This class provides the ability to automatically or manually generate combined DNA sequences from the V(D)J sequences and all its associated information;

BlastTable provides all the information regarding diversity scores, cluster number and performs the BLAST search for a specified sequence;

SequenceHistorian is a class that keeps track of the DNA sequences in nucleotide format that have been ordered from the DNA synthesis company (e.g., IDT, Genscript, Invitrogen, and the like). Persistence is achieved by using a text file named SequenceHistory.txt, which keeps track of all of the sequences in nucleotide format ordered from the DNA Synthesis Company and SequenceContainer is a class that holds all the V(D)J sequence information and restriction sites as specified in the text file SequencesDatabase.txt.

DnaSequence is the parent class that models the heavy and light chain sequences through the use of HeavyChainDnaSequence and LightChainDnaSequence classes, respectively.

WellPlate_8×12 is a class that models a 96-well plate. It holds references to the DNA sequence instances and allows them to be saved into an order file.

Additionally, there are three helper classes within the DNA Sequence Compilation Rules:

CodonUsageTable is a class that encapsulates the codon usage table for *E. coli* K12;

Translator is a static class that performs the translation of the sixty four codons to their respective amino acid equivalents based on the genetic code; and ProtoParam is a static class that computes the GRAVY value.

The following is a discussion of each of the six main classes (i-vi) and the three helper classes (vii-ix) of the DNA Sequence Compilation Rules Module.

i. SequenceCompiler

SequenceCompiler is a singleton class that provides all the DNA sequence compilation functionality. This class provides the ability to automatically or manually generate combined DNA sequences from the V(D)J sequences and all its associated information. Sequence Compiler includes the following functionalities:

1) Algorithm for Automatic DNA Sequence Compilation

Figure 8:
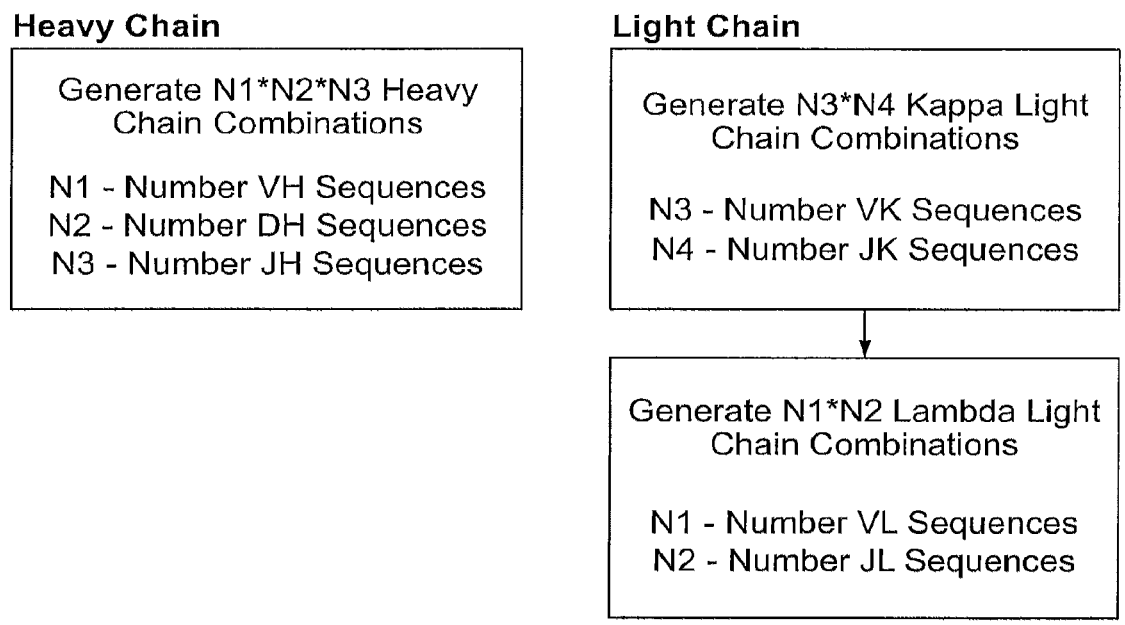
FIG. 8: Algorithm for Heavy and Light Chain Combinations

SequenceCompiler uses the algorithm shown in FIG. 8 to generate compiled sequences by computing all the possible combinations of the available V(D)J sequences for the heavy and light chains. The algorithm equates to simply computing all the possible combinations of the available V(D)J sequences for the heavy and light sequences, respectively.

For example, if there are three $V_H$ sequences, three $D_H$ sequences and three $J_H$ sequences, the algorithm computes 3*3*3 combinations, thereby producing all 27 possible combined sequences. Similarly, if there are four $V_\kappa$ sequences and four $J_\kappa$ sequences, the algorithm computes 4*4 combinations, thereby producing 16 possible combined sequences. In addition, the algorithm computes lambda light chains and kappa light chains separately.

2) Sequence Compilation

Actual sequence compilation starts with the identification of a $V_H$, $D_H$, and $J_H$ sequence and a $V_L$ and $J_L$ sequence for a heavy and light chain respectively from the SequenceDatabase.txt file. Individual segments are identified as described in Example 4. Once the individual segments are identified, V(D)J joints are created, and finally all nucleotide pieces (the segments and the joints) are joined together thus compiling the sequence (see FIG. 9). The rules for joint generation, removal of STOP codons and restriction sites are set forth below under Section Headings "V(D)J Joint Generation," "Stop Codon Removal," and "Codon Usage Table," respectively.

3) V(D)J Joint Generation

The joints in the compiled sequences between the different V(D)J sequences are selected so that the resulting sequences are in frame. SequenceCompiler uses the following three rules for determining reading frames.

1. The V Sequence is always reading frame 1.
2. The D Sequence has a frame that yields the most negative GRAVY (Grand Average of Hydropathy) value.
3. The J Sequence has a reading frame as specified in the SequenceDatabase.txt file (see Example 4.1 entitled "Creating the V(D)J Sequence Database File," which describes that the J sequences are set forth in three letter codons to designate the reading frame; also see Table 13).

Based on the rules listed above, in the joints between sequences, a codon will not automatically be generated by simply recombining the bases from either of the sequences. SequenceCompiler uses the rules listed in Table 19 to generate a new codon. For example, when creating a light chain V-J joint where the V sequence is in reading frame 1 and the J sequence is in reading frame 1, a "G" nucleotide will be inserted between the V-J joint, thereby maintaining the reading frame of the entire segment.

TABLE 19

V(D)J joint generation.

| V-D Joints V | (Heavy Chains) D | Frame | Rule |
|---|---|---|---|
| 0 | 0 | 0 | NO MANIPULATION |
| 0 | 1 | 1 | Delete 1 nucleotide from 5' end of D |
| 0 | 2 | 2 | Add a "G" between V-D |
| 1 | 0 | 1 | Delete 1 nucleotide from 3' end of V |
| 1 | 1 | 2 | Add a "G" between V-D |
| 1 | 2 | 3 | NO MANIPULATION |
| 2 | 0 | 2 | Add a "G" between V-D |
| 2 | 1 | 3 | NO MANIPULATION |
| 2 | 2 | 4 | Delete 1 nucleotide from 3' end of V |

| D-J Joints D | (Heavy Chains) J | Frame | Rule |
|---|---|---|---|
| 0 | 0 | 0 | NO MANIPULATION |
| 0 | 1 | 1 | Delete 1 nucleotide from 5' end of J |
| 0 | 2 | 2 | Add a "G" between D-J |
| 1 | 0 | 1 | Delete 1 nucleotide from 3' end of D |
| 1 | 1 | 2 | Add a "G" between D-J |
| 1 | 2 | 3 | NO MANIPULATION |
| 2 | 0 | 2 | Add a "G" between D-J |
| 2 | 1 | 3 | NO MANIPULATION |
| 2 | 2 | 4 | Delete 1 nucleotide from 3' end of D |

| V-J Joints V | (Light Chains) J | Frame | Rule |
|---|---|---|---|
| 0 | 0 | 0 | NO MANIPULATION |
| 0 | 1 | 1 | Delete 1 nucleotide from 5' end of J |
| 0 | 2 | 2 | Add a "G" between V-J |
| 1 | 0 | 1 | Delete 1 nucleotide from 3' end of V |
| 1 | 1 | 2 | Add a "G" between V-J |
| 1 | 2 | 3 | NO MANIPULATION |
| 2 | 0 | 2 | Add a "G" between V-J |
| 2 | 1 | 3 | NO MANIPULATION |
| 2 | 2 | 4 | Delete 1 nucleotide from 3' end of V |

4) Stop Codon Removal

There are situations where V(D)J joint generation will generate a STOP codon (TAA, TAG or TGA). SequenceCompiler removes detrimental STOP codons according to the following rules, whereby nucleotides encoding a Stop Codon are replaced with the designated new codon:

| STOP Codon | New Codon |
|---|---|
| TAA | TAT |
| TAG | TAT |
| TGA | TCA |

Once SequenceCompiler has completed the successive steps of V(D)J joint generation and STOP codon removal, the protein sequence is complete and functional.

5) Algorithm for Ranking Sequences

Figure 17:
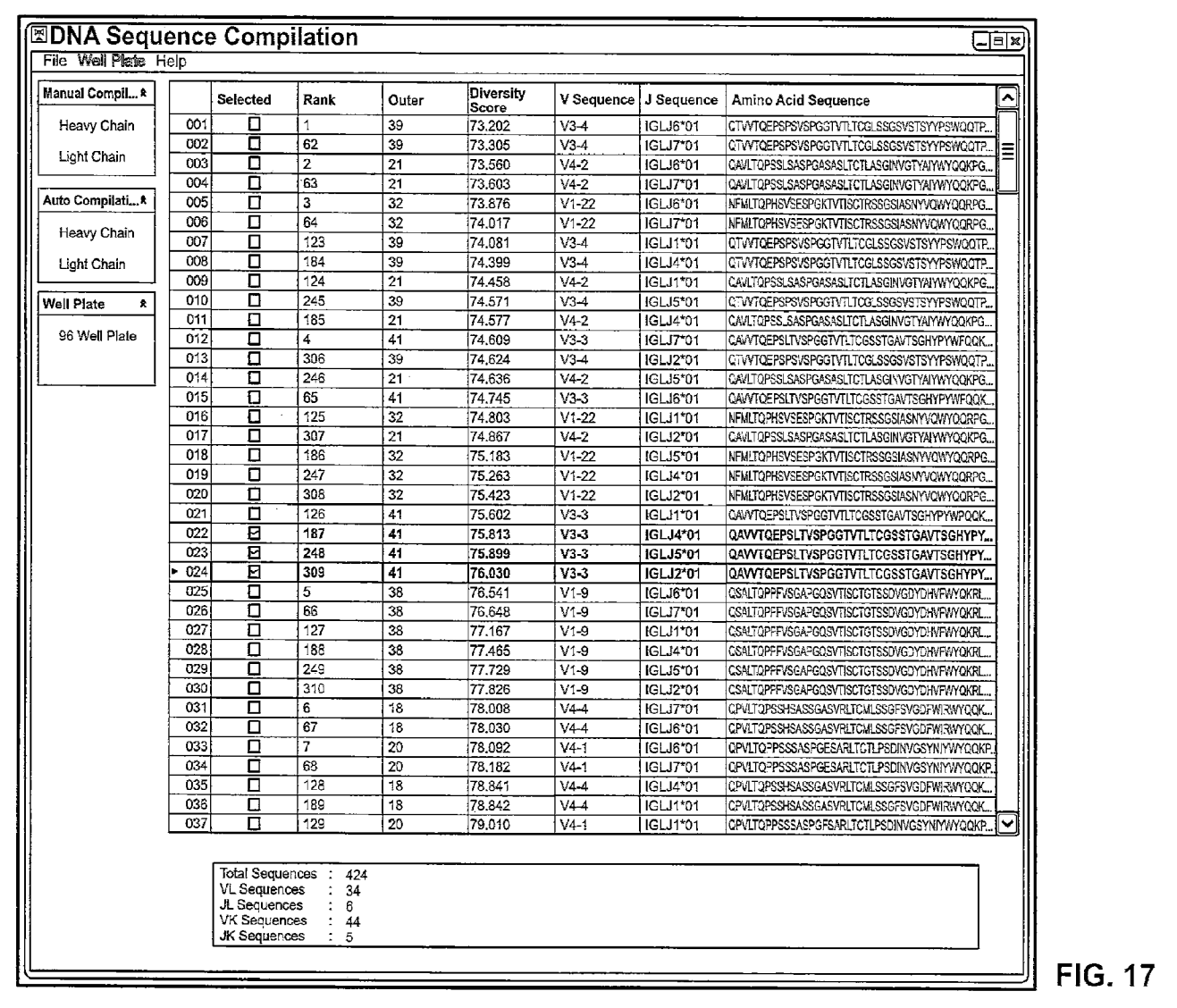

Once sequences are compiled, each sequence is ranked and presented to the user in order of highest diversity to lowest diversity (See Table 20 and FIGS. 17 and 19). This presentation of ranked sequences allows the user several options when selecting sequences to be placed in the 96-well plate order file. The user can select the most diverse sequences, or sequences that are most similar to each other.

Figure 10:
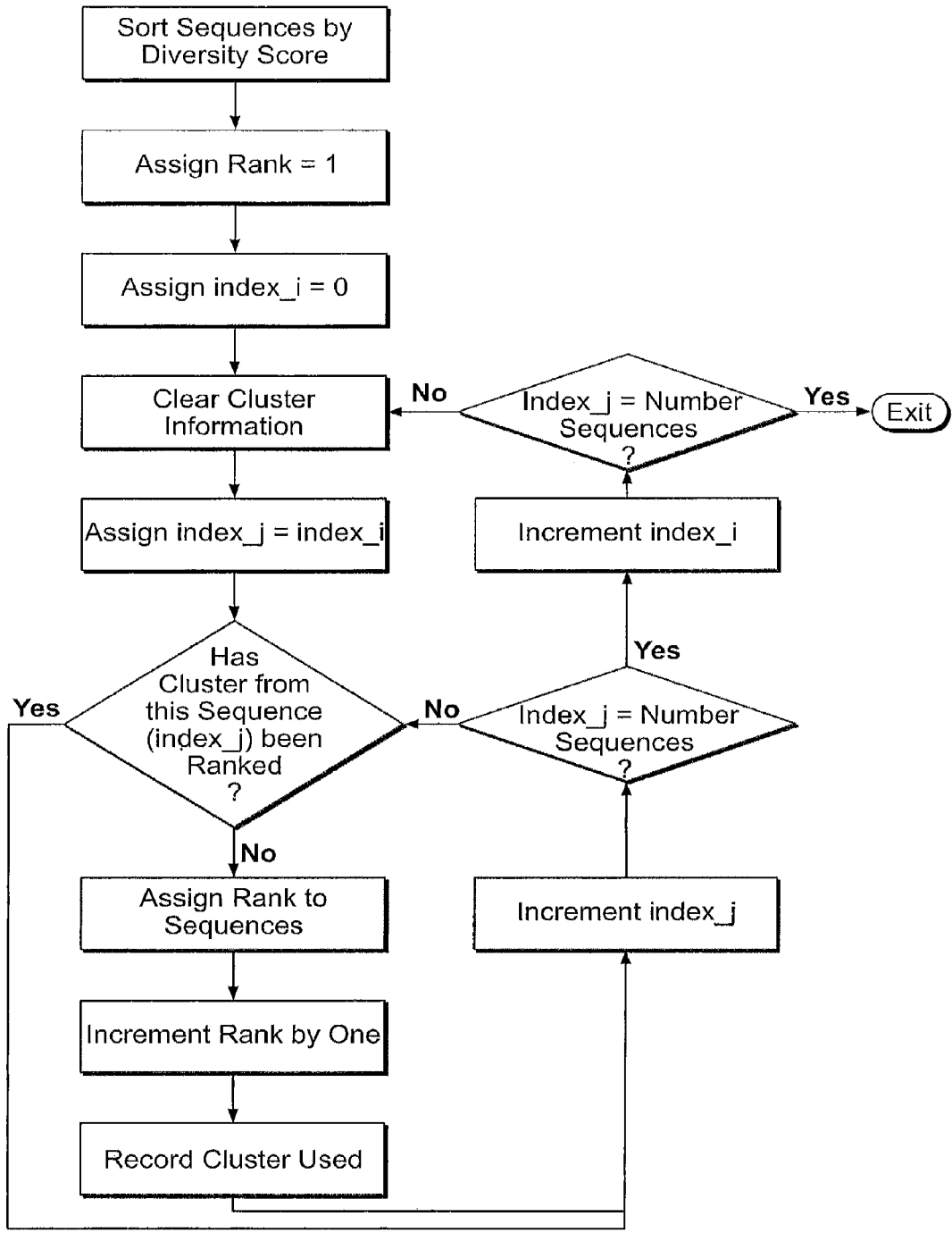
FIG. 10: Algorithm for Ranking Sequences

Compiled sequences are ranked by the software by using a combination of the diversity score and cluster number information for the sequences. Diversity scores are generated by the blast to diversity converter module, as described in Section B.1.e, and cluster information is generated by BLAST-Clust, as described in Section B.1.i. The sequence ranking algorithm flowchart is shown in FIG. 10. The algorithm picks from each cluster the sequence with the lowest diversity score, orders those sequences in terms of diversity from the lowest diversity number to the highest diversity number (a low diversity score indicates lack of similarity, and therefore highest diversity), ranks the sequences in that order, eliminates those sequences from the respective clusters, and then iteratively applies the previous procedure until all the sequences are ranked.

An example of the ranking of Sequences using this algorithm is set forth in Table 20. The sequences in the table are ordered from highest diversity to lowest diversity. The sequence with the lowest diversity score indicates the highest diversity and receives the rank of 1. The second sequence belongs to the same cluster as the first sequences, and receives the rank of 64. This data also indicates to the user that there are a total of 63 clusters defined, since sequence 001 and sequence 002 are both in cluster 39 and they have consecutive diversity scores.

TABLE 20

Ranking of Sequences

| Selected | Rank | Cluster | Diversity Score | V Sequence | J Sequence | Amino Acid Sequence | SEQ ID NO |
|---|---|---|---|---|---|---|---|
| 001 | 1 | 39 | 73.202 | V3-4 | IGLJ6*01 | QTWTQEPSFSVSP . . . | 1905 |
| 002 | 64 | 39 | 73.305 | V3-4 | IGLJ7*01 | QTWTQEPSFSVSP . . . | 1906 |

TABLE 20-continued

Ranking of Sequences

| Selected | Rank | Cluster | Diversity Score | V Sequence | J Sequence | Amino Acid Sequence | SEQ ID NO |
|---|---|---|---|---|---|---|---|
| 003 | 2 | 21 | 73.560 | V4-2 | IGLJ6*01 | QAVLTQPSSLSASP . . . | 1907 |
| 004 | 65 | 32 | 73.603 | V4-2 | IGLJ7*01 | QAVLTQPSSLSASP . . . | 1908 |
| 005 | 3 | 32 | 73.876 | V1-22 | IGLJ6*01 | NFMLTQPHSVSES . . . | 1909 |
| 006 | 66 | 24 | 74.017 | V1-22 | IGLJ7*01 | NFMLTQPHSVSES . . . | 1910 |
| 007 | 4 | 24 | 74.040 | V5-1 | IGLJ7*01 | LPVLTQPPSASALL . . . | 1911 |
| 008 | 67 | 39 | 74.056 | V5-1 | IGLJ6*01 | LPVLTQPPSASALL . . . | 1912 |
| 009 | 127 | 39 | 74.081 | V3-4 | IGLJ1*01 | QTWTQEPSFSVSP . . . | 1881 |
| 010 | 190 | 21 | 74.399 | V3-4 | IGLJ4*01 | QTWTQEPSFSVSP . . . | 1913 |
| 011 | 128 | 39 | 74.458 | V4-2 | IGLJ1*01 | QAVLTQPSSLSASP . . . | 1914 |
| 012 | 253 | 21 | 74.571 | V3-4 | IGLJ5*01 | QTWTQEPSFSVSP . . . | 1915 |
| 013 | 191 | 21 | 74.577 | V4-2 | IGLJ4*01 | QAVLTQPSSLSASP . . . | 1883 | ii. BlastTable

BlastTable provides all the information regarding diversity scores, cluster number and performs the BLAST search for a specified sequence;

iii. SequenceHistorian

SequenceHistorian is a class that keeps track of the DNA sequences in nucleotide format that have been ordered for DNA synthesis. The persistence is achieved by using a text file named SequenceHistory.txt.

iv. SequenceContainer

SequenceContainer is a class that reads V(D)J sequences and restriction sites from a text file and stores them in memory for later retrieval for either manual (i.e. restricted selection) or automatic compilation.

v. DnaSequence

DnaSequence is the parent class that models the heavy and light chain sequences through the use of HeavyChainDnaSequence and LightChainDnaSequence classes, respectively. The only difference between the HeavyChainDnaSequence and LightChainDnaSequence classes is in the way the sequence is compiled which is implemented in the constructor of each class.

Each class contains Fields, Properties and Methods. In addition, the parent DnaSequence class contains events and Nested Types. Thus, DnaSequence implements all the functionality that is common to heavy chain and light chain sequences. This includes the fields such as AminoAcids, Cluster, DiversityScore, _SEQ_ID, Name, Notes, Nucleotides, Rank, and RestrictionSites and methods such as removing restriction sites, removing stop codons and silencing restriction sites. HeavyChainDnaSequence class contains fields for the $V_H$, $J_H$ and $D_H$ sequences, the $V_H$-$J_H$ and $J_H$-$D_H$ joints and methods to generate the $V_H$-$J_H$ and $J_H$-$D_H$ joints. LightChainDnaSequence class contains fields for the $V_L$ and $J_L$ sequences, the $V_L$-$J_L$ joint and methods to generate the $V_L$-$J_L$ joint.

vi. WellPlate__8×12

WellPlate__8×12 is a class that models a 96-well plate. It holds references to the DNA sequence instances and allows them to be saved into an order file.

vii CodonUsageTable

CodonUsageTable is a class that encapsulates the codon usage table for *E. coli* K12 (see, Table 14). The CodonUsageTable is used by the software to modify reading frame problems as well as restriction site silencing. The software is programmed to recognize restriction sites that will be used to insert the DNA into the desired plasmid. When these restriction sites are observed in the compiled DNA sequence, the software modifies the nucleotide sequence to modify the undesired restriction site while maintaining the appropriate amino acid sequence. The above mentioned codon redundancy is used to modify codons. A codon change is used to provide a beneficial increase in the frequency of usage of the possible newly used codon. In addition, modifying the last base of a codon (the degenerate position) is preferred over modifying the first or second base of the codon.

viii. Translator

Translator is a static class that performs the translation of the sixty four codons to their respective amino acid equivalents based on the genetic code.

TABLE 20

DNA Codon table.

| Amino Acid | SLC | DNA codons |
|---|---|---|
| Isoleucine | I | ATT, ATC, ATA |
| Leucine | L | CTT, CTC, CTA, CTG, TTA, TTG |
| Valine | V | GTT, GTC, GTA, GTG |
| Phenylalanine | F | TTT, TTC |
| Methionine | M | ATG |
| Cysteine | C | TGT, TGC |
| Alanine | A | GCT, GCC, GCA, GCG |
| Glycine | G | GGT, GGC, GGA, GGG |
| Proline | P | CCT, CCC, CCA, CCG |

TABLE 20-continued

DNA Codon table.

| Amino Acid | SLC | DNA codons |
|---|---|---|
| Threonine | T | ACT, ACC, ACA, ACG |
| Serine | S | TCT, TCC, TCA, TCG, AGT, AGC |
| Tyrosine | Y | TAT, TAC |
| Tryptophan | W | TGG |
| Glutamine | Q | CAA, CAG |
| Asparagine | N | AAT, AAC |
| Histidine | H | CAT, CAC |
| Glutamic acid | E | GAA, GAG |
| Aspartic acid | D | GAT, GAC |
| Lysine | K | AAA, AAG |
| Arginine | R | CGT, CGC, CGA, CGG, AGA, AGG |
| Stop codons | Stop | TAA, TAG, TGA |

In this table, the twenty amino acids found in proteins are listed, along with the single-letter code used to represent these amino acids in protein data bases. The DNA codons representing each amino acid are also listed. All 64 possible 3-letter combinations of the DNA coding units T, C, A and G are used either to encode one of these amino acids or as one of the three stop codons that signals the end of a sequence. While DNA can be decoded unambiguously, it is not possible to predict a DNA sequence from its protein sequence. Because most amino acids have multiple codons, a number of possible DNA sequences might represent the same protein sequence.

ix. ProtoParam

ProtoParam is a static class that computes the GRAVY value. The GRAVY (Grand Average of Hydropathy) value for a peptide or protein is calculated as the sum of hydropathy values of all the amino acids divided by the number of residues in the sequence (Table 21). In essence, the GRAVY score is the relative value for the hydrophobic residues of the protein. This information is used by the V(D)J joint generation software when computing the D sequence reading frame. This reading frame is determined by the most negative GRAVY value.

TABLE 21

Hydropathy Values

| Amino Acid | Hydropathy Value |
|---|---|
| Ala | 1.800 |
| Arg | -4.500 |
| Asn | -3.500 |
| Asp | -3.500 |
| Cys | 2.500 |
| Gln | -3.500 |
| Glu | -3.500 |
| Gly | -0.400 |
| His | -3.200 |
| Ile | 4.500 |
| Leu | 3.800 |
| Lys | -3.900 |
| Met | 1.900 |
| Phe | 2.800 |
| Pro | -1.600 |
| Ser | -0.800 |
| Thr | -0.700 |
| Trp | -0.900 |

TABLE 21-continued

Hydropathy Values

| Amino Acid | Hydropathy Value |
|---|---|
| Tyr | -1.300 |
| Val | 4.200 | d. DNA Sequence Compilation Rules Test Module

The DNA Sequence Compilation Rules Test module is a collection of NUnit automated tests that perform unit tests for each class. These tests help to ensure the individual modules and classes listed are running properly. These nine classes include:

BlastTableTest;
CodonUsageTableTest;
HeavyChainDnaSequenceTester;
LightChainDnaSequenceTester;
ProtoParamTest;
SequenceCompilerTest,
SequenceContainerTest;
TranslatorTest; and
TranslatorWrapper.

e. Blast to Diversity Converter Module

The Blast to Diversity Converter is an executable that takes a BLAST output file and outputs a diversity score. It contains five classes:

Program—a static class that is automatically generated and contains the execution entry point to the application;
Main Form—a button for the operator to click on to select a file to be converted;
Resources—an empty resource file that is created by default;
Settings—an automatically generated class that contains the user settings; and
BlastConverter—a class that contains the implementation of the conversion of the BLAST output file to a diversity score file.

i. BLAST Converter Algorithm

The BLAST converter algorithm takes a BLAST output file and applies the following equation to compute a sequence's diversity score.

$$DiversityScore(seq_i) = \sqrt{\frac{1}{N} \sum_{k=1, k \neq i}^{N} BLAST(i, k)^2}$$

The algorithm computes a standard deviation for the BLAST scores by taking all the individual BLAST numbers, squaring them, adding up all the squares, normalizing by the number of samples (N), and then taking the square root.

For example, a sequence's diversity score was computed by applying the algorithm to the following BLAST output file (-m 9 BLAST switch, i.e.Alignment view options, tablular with comment lines; see Section B.1.h.):

BLASTP 2.2.17
Query: gnl|Fabrus|V4-2_IGLJ2*01
Database: AllLightChainSequences.txt
Fields: Query id, subject id, % identity, alignment length, mismatches, gap openings, q. start, q. end, s. start, s. end, e-value, bit score
gnl|Fabrus|V4-2_IGLJ2*01   gnl|Fabrus|V4-2_IGLJ2*01   100.00 116 0 0 1 116 1 116 1e-050 186
gnl|Fabrus|V4-2_IGLJ2*01   gnl|Fabrus|V4-2_IGLJ7*01   98.28 116 2 0 1 116 1 116 2e-049 182 gnl|Fabrus|V4-2_IGLJ2*01   gnl|Fabrus|A5_IGKJ7*01
    38.82 85 46 3 31 115 34 112 2e-007 43.1
BLASTP 2.2.17
Query: gnl|Fabrus|V4-2_IGLJ1*01
Database: AllLightChainSequences.txt
Fields: Query id, subject id, % identity, alignment length, mismatches, gap openings, q. start, q. end, s. start, s. and, e-value, bit score
gnl|Fabrus|V4-2_IGLJ1*01   gnl|Fabrus|V4-2_IGLJ1*01
    100.00 116 0 0 1 116 1 116 3e-050 185
gnl|Fabrus|V4-2_IGLJ1*01   gnl|Fabrus|V4-2_IGLJ6*01
    98.28 116 2 0 1 116 1 116 4e-049 181

The following output file is generated, which provide diversity scores for the respective variable heavy chain sequences. The lowest diversity score indicates the least similarity between the sequence and the next most related sequence, and therefore has the highest diversity.

gnl|Fabrus|VH1-69_IGHD7-27*01_IGHJ2*01
    119.675348536301
gnl|Fabrus|VH3-15_IGHD5-24*01_IGHJ2*01
    136.102291820977
gnl|Fabrus|VH2-26_IGHD1-7*01_IGHJ4*01
    111.073223319952
gnl|Fabrus|VH3-13_IGHD1-14*01_IGHJ1*01
    136.760646289454
gnl|Fabrus|VH3-30_IGHD6-13*01_IGHJ6*01
    139.423052600581 f. NUnit

NUnit is a unit-testing framework for all .Net languages. NUnit testing tools provide a means to test an object model, and is useful in ensuring that the application and its logic work correctly. Initially ported from JUnit, the current production release, version 2.4.2, is the fifth major release of this xUnit based unit testing tool for Microsoft .NET. It is written entirely in C# and has been completely redesigned to take advantage of many .NET language features, for example custom attributes and other reflection related capabilities. NUnit brings xUnit to all .NET languages. NUnit is available free to the public from the organization NUnit.

g. Formatdb

Formatdb must be used in order to format protein or nucleotide source databases before these databases can be searched by blastall, blastpgp or MegaBLAST. The source database can be in either FASTA or ASN.1 format. Once a source database has been formatted by formatdb it is not needed by BLAST.

The following Command Line Options are used when generating output files with formatdb:
    -i Input File for formatting
    -p Type of File (T—protein; F—nucleotide; Default =T)
    -o Parse options
        T—True: Parse SeqID and create indexes
        F—False: Do not parse SeqID. Do not create indexes.

The version win32-ia32 (2.2.17) is currently used. Formatdb can be downloaded from the National Center for Biotechnology Information.

h. The Basic Local Alignment Search Tool (BLAST)

The Basic Local Alignment Search Tool (BLAST) finds regions of local similarity between sequences. The program compares nucleotide or protein sequences to sequence databases and calculates the statistical significance of matches. BLAST can be used to infer functional and evolutionary relationships between sequences as well as help identify members of gene families.

The following Command Line Options are used when generating output files with blastall:
    -p Program Name ("blastp", "blastn", "blastx", "tblastn", or "tblastx")
    -d Database
    -l Query File
    -o BLAST report Output File
    -m Alignment View Options (0=default; 9=tabular with comment lines)
    -b Number of Database Sequence to show alignments for (B) [Integer]

The version win32-ia32 (2.2.17) is currently used. BLAST can be downloaded from the National Center for Biotechnology Information.

i. BLASTClust

BLASTClust is a program within the stand alone BLAST package used to cluster either protein or nucleotide sequences. The program begins with pairwise matches and places a sequence in a cluster if the sequence matches at least one sequence already in the cluster. In the case of proteins, the blastp algorithm is used to compute the pairwise matches; in the case of nucleotide sequences, the Megablast algorithm is used.

In the simplest case, BLASTClust takes as input a file containing concatenated FASTA format sequences, each with a unique identifier at the start of the definition line. BLASTClust formats the input sequence to produce a temporary BLAST database, performs the clustering, and removes the database at completion. Hence, there is no need to run formatdb in advance to use BLASTClust. The output of BLASTClust is a file, with one cluster to a line, of sequence identifiers separated by spaces. The clusters are sorted from the largest cluster to the smallest.

The following Command Line Options are used when generating output files with blastclust:
    -d Sequence Database Name
    -o Output File to save cluster list
    -S Similarity Threshold
        if <3 then the threshold is set as a BLAST score density (0.0 to 0.3; default=1.75)
        if >3 then the threshold is set as a percent of identical residues (3 to 100)

The version win32-ia32 (2.2.17) is currently used. BLASTClust can be downloaded from the National Center for Biotechnology Information j. XPExplorerBar The XPExplorerBar is a fully customizable Windows XP style Explorer Bar that supports Windows XP themes and animated expand/collapse with transparency. The XP Explorer Bar is available as free public domain software.

Example 3

Sequence Database

The DNA Sequence compilation software requires a file containing sequence information used by the program to perform sequence compilation in accordance with sequence compilation rules. This is called the SequenceDatabase.txt file. All recombined sequences are generated from the sequence data in the file. Hence, the file contains all sequences that are used in performing the sequence compilation by the software. For example, the file contains nucleotide sequences for all desired germline segments and also contains nucleotide recognition sequences for restriction enzyme. The sequences in the database include any known sequence, and can be updated manually at any time. V, D, and J antibody germline sequences of human origin were obtained from the NCBI IgBLAST database (available from the National Center for Biotechnology Information) and the International ImMunoGeneTics Information system (IMGT) and were entered into a sequence database file. The database file served as an input file for the Sequence Compilation Software.

The format of the SequenceDatabast.txt file is illustrated in FIG. 11. The SequencesDatabase.txt file is updated by simply manually adding new sequences according to the following rules:
All sequences must be specified using the FASTA format.
Three letter codons are specified for J sequences.
All sequences must have a "blank line" between them.
// is used a the beginning of any line containing extraneous comments.
Section titles are indicated by the following designations:
[VH]—List of $V_H$ sequence to follow.
[DH]—List of $D_H$ sequence to follow.
[JH]—List of $J_H$ sequence to follow.
[VK]—List of $V_\kappa$ sequence to follow.
[JK]—List of $J_\kappa$ sequence to follow.

tered by sequence similarity. These various steps of the software were performed immediately upon initiating the software and are described below.

1. Compiling Heavy Chains and Light Chains

Once the database file was updated and contains all the desired V(D)J sequences, the database file was used as an input file by DNA Sequence Compilation software to mechanically compile full length heavy chain or light chain sequences in accordance with the DNA sequence compilation rules as described in Example 2, Section B.1.c. The software created files containing the full-length amino acid sequences encoded by compiled variable heavy and light chain germline segments. These are contained in the following two files:
TempLightChainSequences.txt—This file contains all the lambda and kappa light chain sequence combinations in the amino-acid format.
TempHeavyChainSequences.txt—This file contains all the heavy chain sequence combinations in the amino-acid format.

The compiled light and heavy chain amino acid sequences are each identified with a unique sequence ID (gnl|Fabrus|V_(D)_J), examples of which are illustrated below.

>gnl|Fabrus|V4-2_1GLJ2*01

(SEQ ID NO: 2027)

QAVLTQPSSLSASPGASASLTCTLRSGINVGTYRIYWYQQKPGSPPQYLLRYKSDSDKQQGSGVPSRFSGSKDASANAGILLISGLQSEDE

ADYYCMIWHSSASVVFGGGTKLTVL

>gnl|Fabrus|VH1-2_IGHD2-21*01_IGHJ1*01

(SEQ ID NO: 2028)

QVQLVQSGAEVKKPGASVKVSCKASGYTFTGYYMHWVRQAPGQGLEWMGWINPNSGGTNYAQKFQGRVTMTRDTSISTAYMELSRLRS

DDTAVYYCAREAYCGGDCYSAEYFQHWGQGTLVTVSS

[VL]—List of $V_L$ sequence to follow.
[JL]—List of $J_L$ sequence to follow.
[Restriction Sites]—List of restriction sites to follow.

Example 4

Generation of Heavy and Light Chain DNA Files and Ranking Analysis

This example describes methods for generating recombined heavy and light chain sequence files that will be used by the DNA Sequence Compilation Software. The files were created immediately upon initiating the software. The files are created from the SequenceDatabase.txt file and are analyzed using public domain software, such as NCBI's formatdb, BLAST and BLASTclust, to compute diversity and clustering information for the sequences included in the database file. The ranking function of the software is performed automatically, but can optionally be used by the user to rank the sequences for selection and ordering for DNA synthesis.

To generate sequence files, a database file that contains DNA sequences for all desired V, (D), and J variable regions sequences was generated as described in Example 3. The DNA Sequence Compilation Software mechanically recombined all heavy chain variable germline segments and light chain variable germline segment sequences in the database into nucleic acid molecules encoding functional amino acid sequences. The software translated the nucleic acid sequence into an amino acid sequence to create sequence files. The recombined amino acid sequences were compared to determine the similarity of each compiled sequence to every other compiled sequence, which was subsequently used to generate a diversity score. Finally, the compiled sequences were clus- 2. Ranking Recombined Variable Heavy and Light Chains Recombined variable heavy and light chain sequences were compared by the software for sequence similarity between and among all recombined sequences. This is performed using the NCBI utility BLAST. The Blast bit score is used to generate a diversity score. Recombined variable heavy and light chain sequences also were analyzed for sequence similarity using cluster analysis (e.g. BLASTclust).

As described in Example 2, under the heading "Alogrithm for ranking Sequences," compiled sequences were ranked by the software by using a combination of the diversity score and cluster number information for the sequences. The ranking occurs automatically upon intiation of the program, and can be viewed by the user using the auto compilation function as described in Example 5 below. For example, FIGS. 17 and 19 exemplify screen shots following auto compilation, and depict columns indiating the cluster, diversity score and rank for exemplary heavy and light chain sequences.

The following sections describe the various steps for determining the diversity score and the cluster in order to rank the sequences using the Alogrthm described in Example 2.

a. Calculating Compiled Sequence Similarity and Diversity Scores

The compiled sequences were compared in order to determine the similarity of each compiled sequence to every other compiled sequence. This information was used to generate a diversity score. To start, the TempLightChainSequences.txt and TempHeavyChainSequences.txt files were copied to a folder (as created by the user) and a DOS command prompt window was opened. The NCBI DNA utility formatdb was used to prepare the files for use by BLAST by first using the following command prompts for the respective light chain and heavy chain files:

Run formatdb -i TempLightChainSequences.txt -p T -o F
Run formatdb -i TempHeavyChainSequences.txt -p T -o F Formatdb must be installed in the folder for which the DOS command prompt window is opened or the utility will not be found. Alternatively, a path can be added to direct the DOS command to utilize formatdb from the folder it was previously installed in. For example, if all the NCBI utilities are downloaded into a folder entitled "NCBIUtilities" then the command prompts are be as follows:

Run NCBIUtilities\bin\formatdb -i TempLightChainSequences.txt -p T -o F
Run NCBIUtilities\bin\formatdb -i TempHeavyChainSequences.txt -p T -o F BLAST command prompts were then used to generate output files LightChainBlastResults.txt and HeavyChainBlastResults.txt. The command prompts are as follows:

Run blastall -p blastp -d TempLightChainSequences.txt -l TempLightChainSequences.txt -o LightChainBlastResults.txt -m 9 -b 500

(The -b value must be equal to or greater than the number of sequences to BLAST.)

Run blastall -p blastp -d TempHeavyChainSequences.txt -l TempHeavyChainSequences.txt -o HeavyChainBlastResults.txt -m 9 -b 8000

(The -b value must be equal to or greater than the number of sequences to BLAST.)

Once the BLAST output files were generated, the BLAST bit score is used to calculate a diversity score for each sequence using the algorithm shown in Example 2, under the sub-section heading "Blast Converter Algorithm" using the following commands:

(a) Run BlastToDiversityConverter.exe (This file runs automatically each time the software is started.)
(b) Open the file LightChainBlastResults.txt
(c) Save this file as AllLightChainSequencesDiversityScores.txt
(d) Open the file HeavyChainBlastResults.txt
(e) Save this file as AllHeavyChainSequencesDiversityScores.txt b. Clustering Compiled Sequences by Sequence Similarity Finally, the sequences are clustered based on sequence similarity by generating pairwise matches using the NCBI utility BLASTClust. BLASTClust is used to generate two output files, AllLightChainsBLastClust.txt and AllHeavyChainsBlastClust.txt. The current example dictates that two sequences must be either 95% or 96% identical to register a pairwise match. The command prompts are as follows:

Run blastclust -d TempLightChainSequences.txt -o AllLightChainsBlastClust.txt -S 95
Run blastclust -d TempHeavyChainSequences.txt -o AllHeavyChainsBlastClust.txt -S 96

The BlastClust setting (-S) can be modified to in order to better suit any individual requirements that are necessary.

Once all the files are generated (as indicated above), the following files are manually copied into the installation folder of the DNA Sequence Compilation Tool.

(a) AllHeavyChainsBlastClust.txt
(b) AllLightChainsBlastClust.txt
(c) AllLightChainSequencesDiversityScores.txt
(d) AllHeavyChainSequencesDiversityScores.txt Example 5

Installation and Graphical User Interface of the DNA Sequence Compilation Tool Software The DNA Sequence Compilation Software is used to recombine heavy and light chain antibody sequences and subsequently select desired sequences to populate a 96-well plate output file, which serves as an order file for purchasing DNA sequences in nucleotide format from a DNA Synthesis Company. This example illustrates the software requirements as well as the controls the user encounters when using the DNA Sequence Compilation Software, including Main Menu Options and Explorer Bar Options.

A. Software Overview

The software is designed to run on a computer that uses Windows XP or Windows Vista as the operating system. The software is installed by running the executable file setup.exe and installing the program in a folder of the users choice. Once installed, the user encounters Main Menu Options as well as Explorer Bar Options. The details are described below.

1. System Requirements

The DNA Sequence Compilation Software has been designed to run on a local machine as a stand alone application.

Operating System: Windows XP/Vista 32-bit Edition
Internet Connection: Not Required
Database Server: None 2. Installation of the DNA Sequence Compilation Tool Program To install the program, run the executable file setup.exe and install the program in a folder of your choice.

3. Main Menu Options (see FIG. 12)

There are three main menu options.

File—The file menu is used to close the application.

Well-Plate—The well-plate menu is used to generate an order, clear the entire plate or a selected well, or configure the restriction sites for the well-plate order generation.

Help—The help menu is used to find out what version of the software you are running.

4. Explorer Bar Options

There are three explorer bar options (see FIG. 12; left column):

Manual Compilation—Manual compilation contains items used to display the light chain or heavy chain manual compilation form, which allows users selection of germline segments.

Auto Compilation—Auto compilation contains items used to display the light chain or heavy chain automatic compilation form.

Well Plate—Well plate contains items used to display the well plate form.

C. Starting the Application

Figure 13:
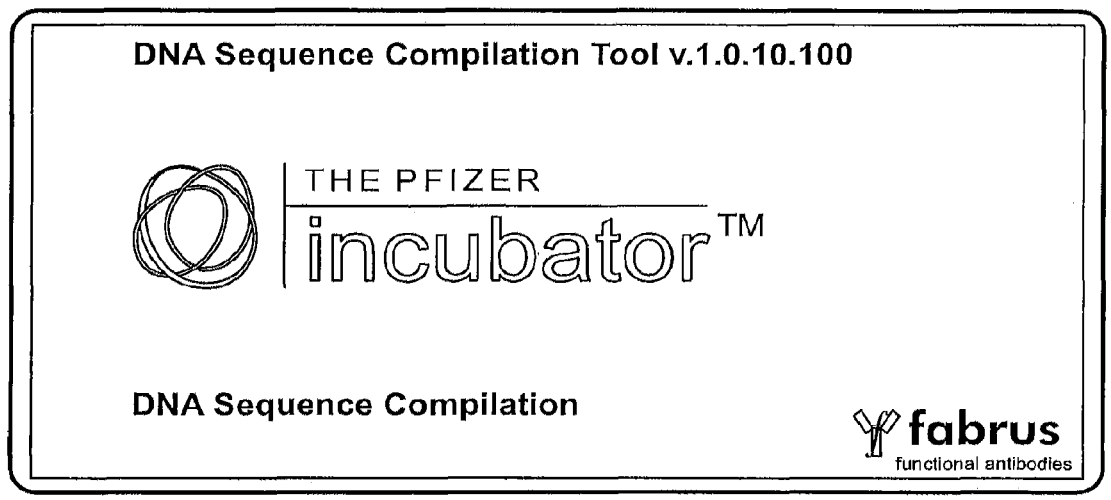
FIG. 13: DNA Sequence Compilation Software Splash Screen

The software is launched either by clicking on the Fabrus DNA Compilation Tool on the All Programs Windows menu or by double-clicking the Fabrus DNA Compilation Tool shortcut on the desktop. A Splash Screen (FIG. 13) appears upon application startup and then fades into the background.

D. Generating an Output Plate Using the DNA Sequence Compilation Software

The DNA Sequence Compilation Software is used to recombine heavy and light chain antibody sequences and subsequently select desired sequences to populate a 96-well plate output file which serves as an order file for purchasing DNA sequences in nucleotide format from a DNA Synthesis Company. In addition to the plate file, a SequenceHistory.txt file is generated to keep track of all sequences ordered. Users can select either manual compilation or auto compilation in order to generate sequences and subsequently select individual sequences for inclusion into the 96-well plate grid, as described below in sections C.2-4. The software program also computes a diversity score for all sequences. The following sections describe user options for selecting and compiling germline sequences encoding variable heavy and light chains for DNA synthesis ordering.

1. The 96-Well Plate Screen

Figure 12:
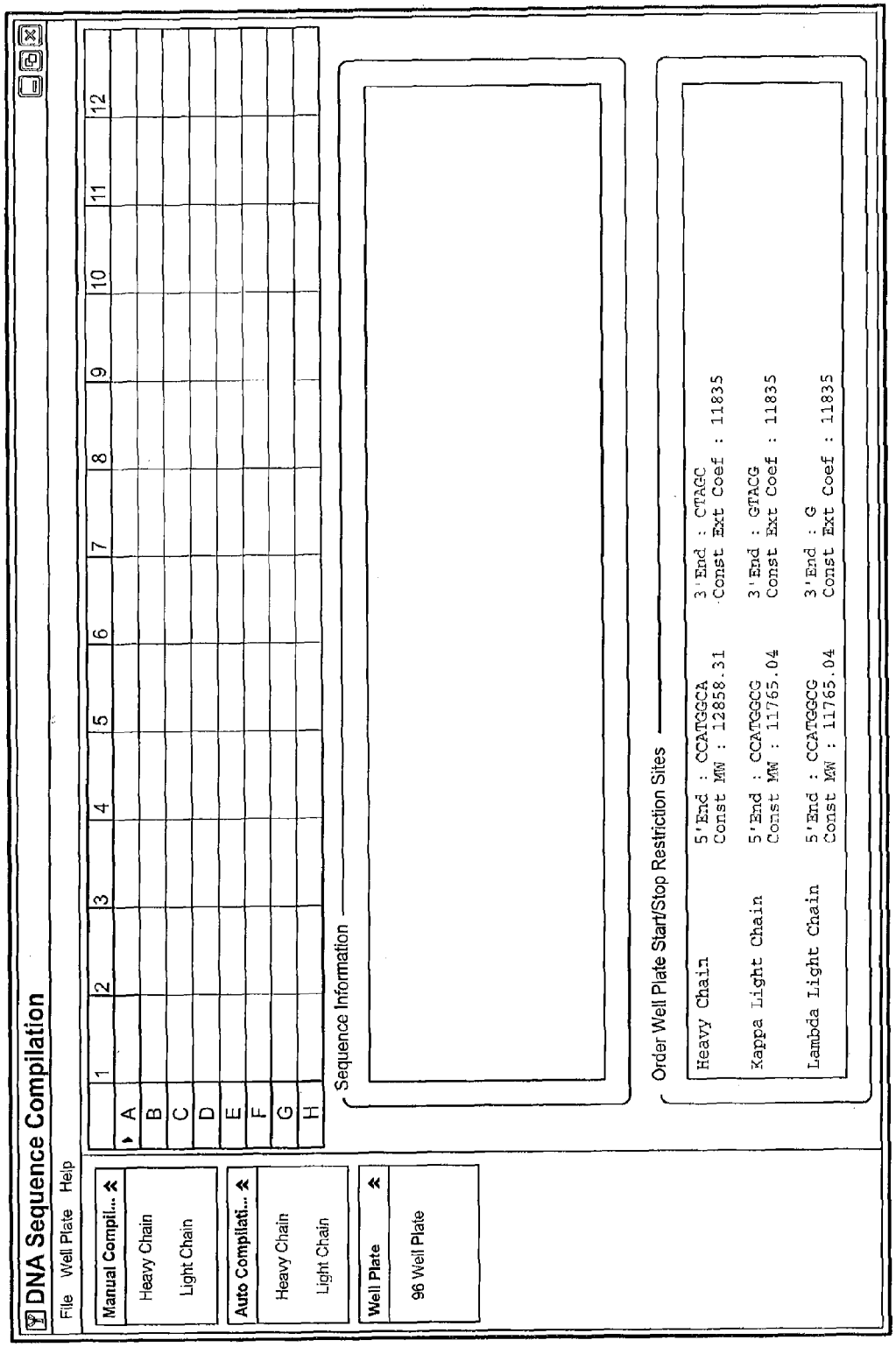
FIG. 12: DNA Sequence Compilation Software Initial Startup Screen

When the application launches, the 96 Well-Plate screen is displayed. As is shown in FIG. 12, the 96-well plate is empty at application startup. The Main Menu is observed horizontally along the top of the screen, underneath the title DNA Sequence Compilation. The Explorer Bar is observed vertically along the left side of the screen. The user must populate the empty 96-well plate with DNA sequences that will be selected for manufacture as described herein below using either the manual compilation function or the automatic compilation function. The operating functions within the 96-well plate screen that permit population of the screen include the following:

a. Selecting Well Plate Restriction Sites

Restriction enzyme sequences are selected by the user from the Sequencedatabase.txt file to add to the compiled DNA sequence at the 5' and 3' ends for cloning purposes. The following commands are used to specify the 5' and 3' restriction sites that are added to the plate order according to antibody chain type:

Heavy Chains:
Well Plate>Configuration>Heavy Chains>5' End→choose; and Well Plate>Configuration>Heavy Chains>3' End→choose.

Kappa Light Chains:
Well Plate>Configuration>Kappa Light Chains>5' End→choose; and Well Plate>Configuration>Kappa Light Chains>3' End→choose.

Lambda Light Chains:
Well Plate>Configuration>Lambda Light Chains>5' End→choose; and WellPlate>Configuration>Lambda Light Chains>3' End→choose.

Figure 14:
FIG. 14: DNA Sequence Compilation Software 96-well Plate Screen

This defines the restriction site that is prefixed and suffixed to each sequence chain type in the order file and can be viewed in the IDT Order Well Plate Start/Stop Restriction Sites box (See FIG. 12 and FIG. 14). The compilation software includes a function to internally search compiled sequences for the chosen restriction site and modify the nucleotide sequence in accord with codon usage to remove any internal restriction sites that can be incompatible for cloning purposes. This is completed prior to placing the sequences in the well plate for ordering such that only those sequences "with restriction sites silenced" are ordered. This is described in Example 2 in the section entitled "Codon usage Tables," and in Section 2 below.

b. Placing Sequences in the Well Plate

The selection of sequences is performed from either manual compilation or auto compilation screens as described below in Sections C.2 and C.3. As described below, in the manual compilation or auto compilation screens, following compilation, sequences are selected by checking the "Selected" column (for auto compilation) or clicking the "Add to Well Plate" button (for manual compilation).

c. Displaying Well Sequence Information

The sequence of a compiled sequence placed in a well is displayed by clicking on the well. The well for the selected sequence is highlighted. For example, FIG. 14 shows a model screen for a single 96-well plate containing compiled sequences which the user has selected for ordering. In row A of the Figure, columns 1-3 (shaded in medium gray) indicate a cell with a compiled heavy chain sequence; columns 3-6 (shaded in light gray) indicate a cell with a compiled light chain sequence. The highlighted cell (row A, column 5, indicated in dark shading) indicates the cell for which the individual data is observed in the Sequence Information box at the bottom of the display.

The Sequence Information text box is then updated with the sequence information for that well. The Sequence Information box lists all the pertinent information for a particular sequence, including the name, the nucleotide sequence, the amino acid sequence, the diversity score and individual component titles for the V(D)J recombination. For example, in FIG. 14, the highlighted sequence is a variable light chain compiled from the $V_L$ germline segment V3-4 and the $J_L$ germline segment IGLJ7*01.

d. Generating an Order

An order is generated for the 96-well plate regardless of how many samples are placed in the plate, i.e. from one (1) to 96 sequences can be ordered from a 96-well plate. To generate an order, the option Well Plate>Generate Order is chosen and a filename is inputted when requested. The order file is saved in a comma separated variable (.csv) format. Example 4 describes compilation, output and ordering of exemplary sequences compiled using the Software compilation software.

e. Clearing a Selected Well of a Well Plate

In order to clear a specific well in the plate, click on the selected well, then choose WellPlate>Clear>Selected Well or, alternatively, right click on the desired well and select "Clear Selected Well".

f. Clearing all Sequences from an Entire Well Plate

The Well Plate is not automatically cleared when an order is generated. In order to clear the entire Well-Plate, choose Well Plate>Clear>Entire Plate.

2. Manual Compilation of Sequences

Compiled sequences can be generated manually by user selection using the Manual Compilation option.

a. Manual Compilation of Light Chains

Figure 15:
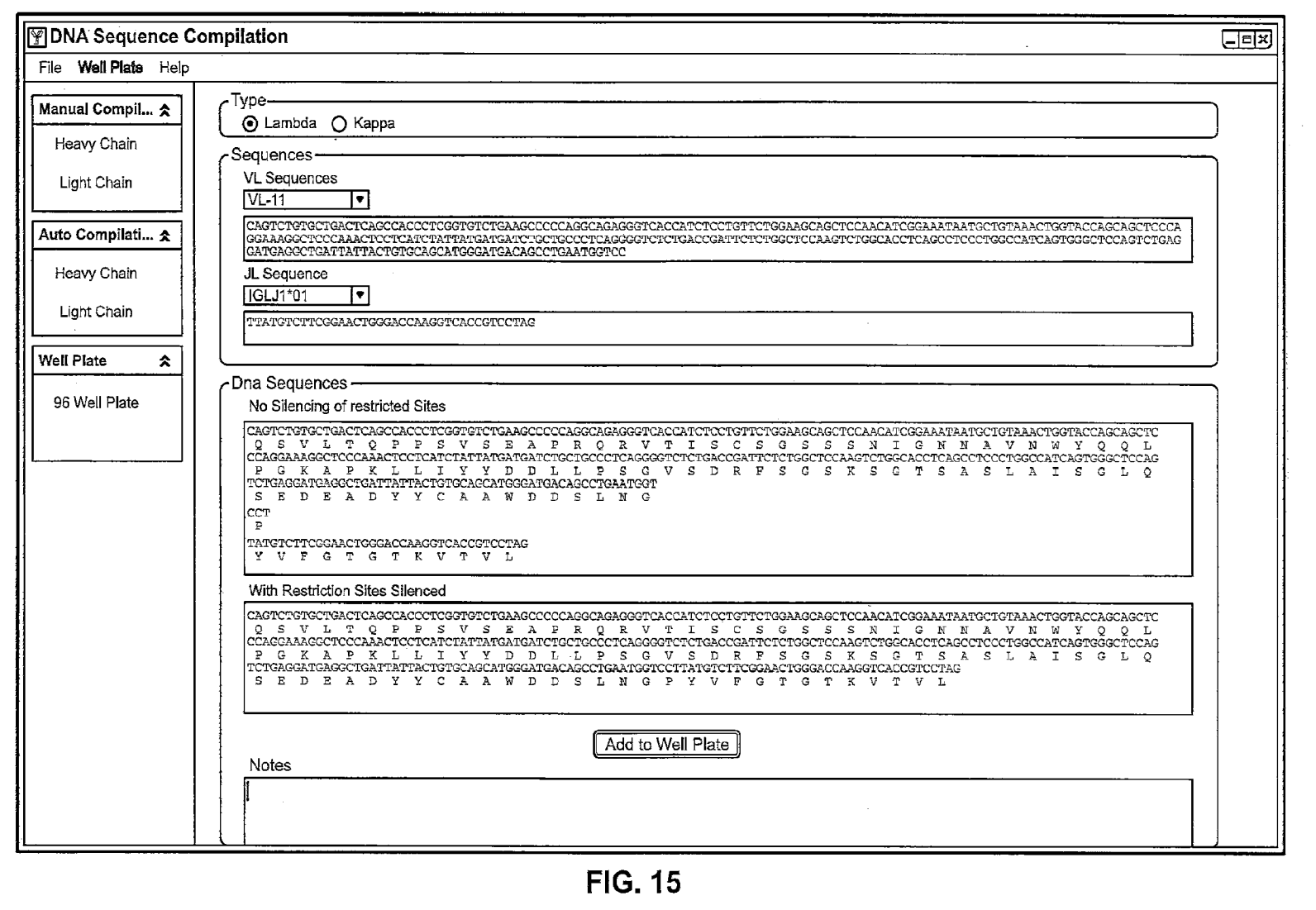

To manually compile a light chain, choose the option Manual Compilation>Light Chain from the explorer bar. The manual compilation screen is displayed in FIG. 15. The manual compilation light chain screen allows the user to compile either a Lambda or Kappa sequence. This option is available under the heading Type and is chosen by selecting the circle in front of either Lambda or Kappa at the top of the screen. The software does not allow the combination of a $V_l$ and a $J_k$ sequence or vice-versa.

i. Compiling Lambda Light Chains

The following steps show how to compile a Lambda Light Chain.

Select Type>Lambda.

Select the desired $V_\lambda$ Sequence from the VL Sequence Combo box. All of the available $V_\lambda$ nucleotide sequences that are entered in the SequenceDatabase.txt file appear in the drop down menu box underneath.

Select the desired $J_\lambda$ Sequence from the JL Sequence Combo Box. All of the available $J_\lambda$ nucleotide sequences that are entered in the SequenceDatabase.txt file appear in the drop down menu box underneath.

Click "Add to Well Plate" button to add the compiled sequence to the well plate.

Two boxes are observed under the Dna Sequence heading. The "No Silencing of restricted Sites" box displays the individual $V_\lambda$ and $J_\lambda$ nucleotide sequences plus any V-J joints generated in accord with the sequence compilation rules. The corresponding encoded amino acid sequence also is displayed. For example, in FIG. 15, the first sequence displayed in the "no silencing of restricted sites" box corresponds to the selected $V_\lambda$ sequence (in this case V1-11). Following this is a depiction of three nucleotides "cct" encoding proline (P), which correspond to the joint region created by performance of the compilation method in order to generate a functional nucleic acid molecule. The last sequence displayed corresponds to the selected $J_\lambda$ sequence (in this case IGLJ1*01). The "With Restriction Sites Silenced" box displays the compiled sequence containing any necessary nucleotide modifications to the sequence to silence restriction sites, while maintaining codon usage. Any restriction sites silenced by the software are displayed in the "Notes" box. The sequence with the restriction sites silenced is the sequence that is placed in the order file.

(ii) Compiling Kappa Light Chains

The following steps show how to compile a Kappa Light Chain.

Select Type>Kappa.

Select the desired VK Sequence from the VK Sequence Combo box. All of the available $V_\kappa$ nucleotide sequences that are entered in the SequenceDatabase.txt file appear in the box underneath.

Select the desired JK Sequence from the JK Sequence Combo Box. All of the available $J_\kappa$ nucleotide sequences that are entered in the SequenceDatabase.txt file appear in the box underneath.

Click "Add to Well Plate" button to add the compiled sequence to the well plate. All compiled sequences are added to the well plate for ordering for DNA synthesis.

As above for compiling lambda light chain sequences, two boxes are observed under the Dna Sequence heading. The "No Silencing of restricted Sites" box displays the individual V and J sequences plus any V-J joints generated. The "With Restriction Sites Silenced" box displays the compiled sequence with any sequence modifications to silence selected restriction sites. Any restriction sites silenced by the software are displayed in the "Notes" box. The sequence with the restriction sites silenced is the sequence that is placed in the order file.

b. Manual Compilation of Heavy Chains

Figure 16:
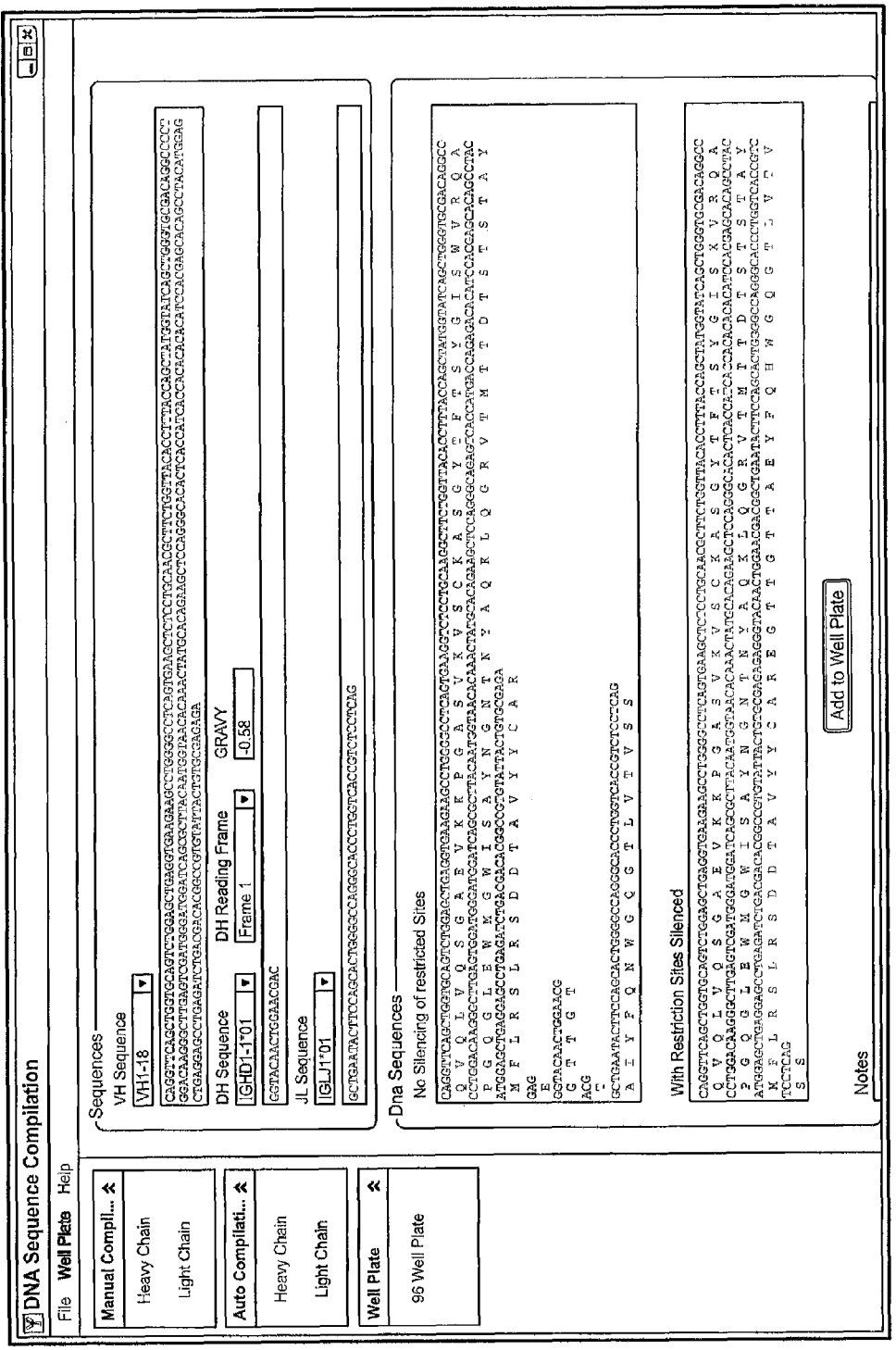
FIG. 16: DNA Sequence Compilation Software Heavy Chain Manual Compilation Screen

To manually compile a heavy chain, choose the option Manual Compilation>Heavy Chain on the explorer bar. The manual compilation screen is displayed in FIG. 16. The manual compilation heavy chain screen allows the user to concatenate $V_H$, $D_H$ and $J_H$ sequences. The following steps show how to compile a heavy chain.

Select the desired $V_H$ Sequence from the VH Sequence Combo box. All of the available $V_H$ nucleotide sequences that are entered in the SequenceDatabase.txt file appear in the drop down menu box underneath.

Select the desired $D_H$ Sequence from the DH Sequence Combo Box. All of the available $D_H$ nucleotide sequences that are entered in the SequencDatabase.txt file appear in the drop down menu box underneath.

Select the desired $D_H$ reading frame from the DH Reading Frame Box. The GRAVY value is updated according to the reading frame selection. The user should select the reading frame that corresponds to the lowest GRAVY value.

Select the desired $J_H$ Sequence from the JH Sequence Combo Box. All of the available $J_H$ nucleotide sequences that are entered in the SequenceDatabase.txt file appear in the box underneath.

Click "Add to Well Plate" button to add the compiled sequence to the well plate. All compiled sequences are added to the well plate for ordering for DNA synthesis.

Two boxes are observed in under the Dna Sequence heading. The "No Silencing of restricted Sites" box displays the individual $V_H$, $D_H$ and $J_H$ sequences plus any V-D-J joints generated in accord with the sequence compilation rules. The corresponding encoded amino acid sequence also is displayed. For example, in FIG. 16, the first sequence displayed in the "no silencing of restricted sites" box corresponds to the selected $V_H$ sequence (in this case VH1-18). Following this is a depiction of three nucleotides "gag" encoding glutamic acid (E), which correspond to the V-D joint region created by performance of the compilation method in order to generate a functional nucleic acid molecule. The next sequence displayed corresponds to the selected $D_H$ sequence (in this case IGHD1-1*01). That sequence is followed by depiction of three nucleotides "acg" encoding threonine (T), which correspond to the D-J joint region created by performance of the compilation method in order to generate a functional nucleic acid molecule. The last sequence displayed corresponds to the $J_H$ selected sequence (in this case IGHJ1*01). The "With Restriction Sites Silenced" box displays the compiled sequence with any restriction sites that are present silenced. Any restriction sites silenced are displayed in the "Notes" box. The sequence with the restriction sites silenced is the sequence that is placed in the order file.

3. Auto Compilation of Sequences

Compiled chains are generated automatically by using the Auto Compilation option. As discussed in Example 4, compilation of all sequences is performed mechanically by the computer upon initiation and stored in files. The auto compilation function permits the user to view these sequences.

a. Auto Compilation of Light Chains

To automatically compile a light chain, choose the option Auto Compilation>Light Chain on the explorer bar. The auto compilation screen is displayed in FIG. 17. The auto compilation light chain screen displays all the possible combinations of $V_\kappa$ and $J_\kappa$, and V and J sequences.

The auto compilation screen shows a grid with the following columns:

Selected—This column contains a box that is either checked or unchecked to add or remove a sequence to or from the well plate.

Rank—This column indicates the rank order in terms of diversity. A value of 1 indicates the most diverse sequence.

Cluster—This column lists the cluster that the sequence is grouped into. The cluster number is simply an identifier and its value is not associated to any sort of ranking.

Diversity Score—This column lists a score based on the root mean square of the BLAST Bit score results of this sequence against all other sequences in this list. A low value indicates a more diverse sequence.

V Sequence—This column lists the V sequence identifier that is used for this sequence.

J Sequence—This column lists the J sequence identifier that is used for this sequence.

Amino Acid Sequence—This column lists the compiled sequence in protein format.

b. Auto Compilation of Heavy Chains

To automatically compile heavy chains, choose the option Auto Compilation>Heavy Chain on the explorer bar. The auto compilation screen is displayed in FIG. 19. The auto compilation heavy chain screen displays all the possible combinations of $V_H$, $D_H$ and $J_H$ sequences.

The auto compilation screen shows a grid with the following columns:

Selected—This column contains a box that is either checked or unchecked to add or remove a sequence to or from the well plate.

Rank—This column indicates the rank order in terms of diversity. A value of 1 indicates the most diverse sequence.

Cluster—This column lists the cluster that the sequence is grouped into. The cluster number is simply an identifier and its value is not associated to any sort of ranking.

Diversity Score—This column lists a score based on the root mean square of the BLAST Bit score results of this sequence against all other sequences in this list. A low value indicates a more diverse sequence.

V Sequence—This column lists the V sequence identifier that is used for this sequence.

D Sequence—This column lists the D sequence identifier that is used for this sequence.

J Sequence—This column lists the J sequence identifier that is used for this sequence.

Amino Acid Sequence—This column lists the compiled sequence in protein format.

4. Other Functionalities Associated with Compilation of Light Chain and Heavy Chain Sequences a. Changing the Sorting Option of the Auto Compilation Screen The view of the sequences listed in the auto compilation screen can be reorganized by clicking on the desired column header. For example, to view sequences based on diversity score, the column header "Diversity Score" is clicked and the sequences are reordered in terms of lowest to highest diversity score.

b. Status Indicators

The auto compilation screen uses color conventions to identify the status of compiled sequences. For example, grey indicates the sequence has already been ordered, blue indicates the sequence has neither been ordered nor placed in the 96-Well Plate, and bold blue indicates the sequence has been placed in the 96-Well Plate. For example, the bolded items in rows 022, 023 and 024 in FIG. 17 indicate that the compiled sequences have been placed in the 96-well plate for ordering, which also is indicated by the check mark in the "selected" column. For example, the bolded items in rows 0103-0107 in FIG. 19 indicate that the compiled sequences have been placed in the 96-well plate for ordering, which also is indicated by the check mark in the "selected" column.

c. Placing Multiple Sequences in the 96-Well Plate

Multiple sequences can be placed into the 96-well plate by clicking on the box for multiple selected sequences. This can be down by selecting a first sequence with the mouse, and then, holding down the Shift key and clicking on the box for the last selected sequence. Alternatively, the Ctrl key can be used to select individual sequences by holding down the Ctrl key and clicking on the individual boxes for all selected sequences. Once VL sequences are selected to add to the 96-well plate, right Click on the row header and select "Copy to Well Plate". All selected sequences are added to the well plate for ordering for DNA synthesis.

d. Placing a Single Sequence in the 96-Well Plate

To place a single sequences into the 96-well plate, click the box in the "Selected" Column; or alternatively, right Click on the Row Header for the sequence and click "Copy to Well Plate". Only the selected sequence is added to the well place for ordering for DNA synthesis.

e. BLAST of a Selected Sequence Against all the Other Sequences in the Compilation.

Figure 18:
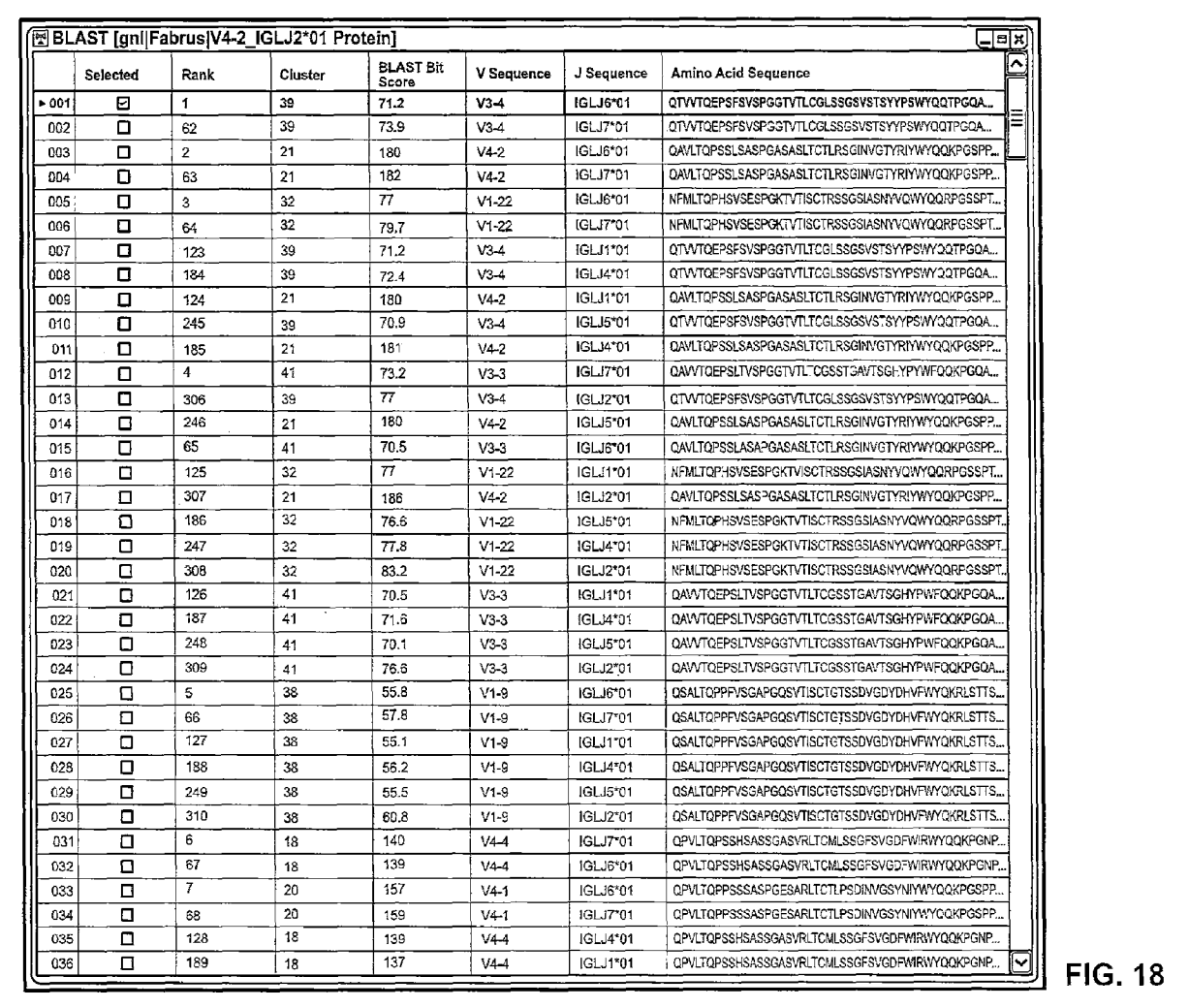

Once the sequences are compiled by auto compilation, the software allows the user the option of performing a BLAST search of a single sequence against all the other sequences in the list. This function provides an output indicator, the BLAST bit score, which is a value calculated from the number of gaps and substitutions associated with each aligned sequence. The higher the score, the more significant the alignment. This data is useful if the user is trying to select sequences that have either the most diversity or alternatively, the least diversity to every other selected sequence. An example of generated data for selected VL sequences is illustrated in FIG. 18 and an example of generated data for selected VH sequences is illustrated in FIG. 20.

The compiled sequences are then compared in order to determine the similarity of each compiled sequence to every other compiled sequence and this information is used to generate a diversity score. For example, the NCBI utility BLAST can be used to find regions of local similarity between sequences, by comparing nucleotide or protein sequences and calculating the statistical significance of matches.

To perform BLAST, the sequence to be compared is selected by clicking on the sequence. The user can select the BLAST option by right clicking the sequence. For example, for VL sequences, FIG. 18 illustrates a BLAST grid form generated by selecting on the V4-2_IGLJ2*01 sequence on a manual compilation or auto compilation screen, followed by right clicking the sequence and selecting Blast. A new grid form was generated, illustrated in FIG. 18, which provides the Blast bit score of other compiled sequences aligned with the selected sequence. For example, for VH sequences, FIG. 20 illustrates a BLAST grid form generated by selecting on the VH4-39_IGHD5-24*01_IGHJ6*01 sequence on a manual compilation or auto compilation screen, followed by right clicking the sequence and selecting Blast. A new grid was generated, illustrated in FIG. 20, which provides the Blast bit score of other compiled sequences aligned with the selected sequence. Sequences can be selected from this new grid form for insertion into the 96-well plate file for ordering for DNA synthesis as indicated by checking the box in the "selected" column.

The BLAST form is a grid with the columns:

Selected—This column contains a box that is either checked or unchecked to add or remove a sequence to or from the well plate.

Rank—This column indicates the rank order in terms of diversity. A value of 1 indicates the most diverse sequence.

BLAST Bit Score—This column indicates the BLAST Bit score for this particular sequence against the selected sequence.

V Sequence—This column lists the V sequence identifier that is used for this sequence.

J Sequence—This column lists the J sequence identifier that is used for this sequence.

Amino Acid Sequence—This column lists the compiled sequence in protein format.

Example 6

Generation of Heavy and Light Chain Germline Recombined DNA Sequences

This example describes methods for generating heavy and light chain DNA sequences by the DNA Sequence Compilation Software. The first step in compilation is to select either manual compilation or automatic compilation of sequences as discussed in Example 5 above. Manual compilation is useful as it gives the user complete control over the selected sequences. This allows the user to cater a library to any desired circumstance, such as creating a library where every sequence contains a particular segment that is the same, or by controlling the diversity by selecting sequences that are different (e.g. from different gene families).

Using manual compilation germline segments were selected by selecting a germline segment from each gene family of a $V_H$, $D_H$, $J_H$, V, J, V or J germline segment. Compilation of the variable heavy chain was performed separate from the light chain. Also compilation of the variable kappa light chain was performed separate from the variable lambda chain. Hence, separate 96-well plate files were created for the variable heavy chain, variable kappa light chain and variable lambda light chain.

For example, for a variable heavy chain, one $V_H$ germline segment from the IGHV1-18 gene family was selected, i.e. IGHV1-18*01; one $V_H$ germline segment from the IGHV1-2 gene family was selected, i.e. IGHV1-2*01; and so on. Similar selections were made for $D_H$ germline segments and JH germline segments. The $D_H$ germline segments were selected in a reading frame to give the lowest gravy score where possible. A combination of $V_H D_H J_H$ germline segments were made one at at time in the Manual compilation screen. In addition, the restriction enzyme sites NcoI and Nhe I were selected from the "well plate" menu for each $V_H D_H J_H$ combination for inclusion at the 5' and 3' ends of the recombined segments to allow for subcloning into appropriate vectors (see Example 8). This resulted in the software automatically viewing in the DNA Sequence Window the sequence of the selected sequence with "no silencing of restricted sites" and "with restriction sites silenced," (i.e. in this case any NcoI or NheI restriction sites present internally in the sequence were silenced by modification using the codon usage table). Generated V-D and D-J joints also were created by the software in accordance with the sequence compilation rules and indicated in the DNA sequence window (an exemplary selection is set forth in FIG. 16). Once germline segment components for a rearranged sequence were selected, it was "added to the well plate." This was repeated for all variable heavy chain germline segment combinations.

Similar selections also were made for the V and J light chain germline by selecting a combination of V and J germline segments (only one gene family member from each germline segment was ever selected) one at a time in the manual compilation screen. In addition, the restriction enzyme sites Nco I and BsiW I were selected from the "well plate" menu for each V and J combination for inclusion at the 5' and 3' ends of the recombined segments to allow for subcloning into appropriate vectors (see Example 8). This resulted in the software automatically displaying in the DNA Sequence Window the sequence of the selected sequence with "no silencing of restricted sites" and "with restriction sites silenced," (i.e. in this case any Nco I or BsiW I restriction sites present internally in the sequence were silenced by nucleotide modification using the codon usage table.) Generated V-J joints also were created by the software in accordance with the sequence compilation rules and indicated in the DNA sequence window. Once germline segment components for a rearranged sequence were selected, it was "added to the well plate." This was repeated for all variable kappa light chain germline segment combinations.

Similar selections also were made for the V or J light chain germline segments by selecting a combination of V or J germline segments (only one gene family member from each germline segment was ever selected) one at at time in the manual compilation screen. In addition, the restriction enzyme sites Nco I and Avr II were selected from the "well plate" menu for each V and J combination for inclusion at the 5' and 3' ends of the recombined segments to allow for subcloning into appropriate vectors (see Example 8) This resulted in the software automatically displaying in the DNA Sequence Window the sequence of the selected sequence with "no silencing of restricted sites" and "with restriction sites silenced," (i.e. in this case any Nco I or Avr II restriction sites present internally in the sequence were silenced by nucleotide modification using the codon usage table.) Generated V-J joints also were created by the software in accordance with the sequence compilation rules and indicated in the DNA sequence window (an exemplary selection is set forth in FIG. 15). Once germline segment components for a rearranged sequence were selected, it was "added to the well plate." This was repeated for all variable lambda light chain germline segment combinations.

The choice of Nhe I, Bsi WI and Avr II sites allow for complete amino acid conservation for their respective heavy and light chains thereby maintaining the natural human V and C regions.

Once all sequences were selected, the selected sequences were viewed under the 96-well plate view (see e.g., FIG. 12 and FIG. 14). A DNA synthesis order was generated using the Generate Order function. The DNA Compilation Software outputted the selected sequences in arrays that mapped to the 96-well format. The sequences in this format were sent to a DNA synthesis vendor (Genscript Corp.) to generate synthetic antibody variable heavy and light chain sequences. The synthesized nucleic acid molecules were returned and identified by the 96-well format. Table 22 lists sequences generated by the Sequence Compilation Software, ordered and synthesized.

TABLE 22

Exemplary Sequences Generated by DNA Compilation Software

| Number | Name | SEQ ID NO. |
|---|---|---|
| | Heavy Chain | |
| 3 | gnl\|Fabrus\|VH1-18__IGHD1-26*01__IGHJ2*01 | 454 |
| 4 | gnl\|Fabrus\|VH1-18__IGHD2-21*01__IGHJ2*01 | 455 |
| 5 | gnl\|Fabrus\|VH1-18__IGHD3-16*01__IGHJ6*01 | 456 |
| 6 | gnl\|Fabrus\|VH1-18__IGHD3-22*01__IGHJ4*01 | 457 |
| 7 | gnl\|Fabrus\|VH1-18__IGHD4-23*01__IGHJ1*01 | 458 |
| 8 | gnl\|Fabrus\|VH1-18__IGHD5-12*01__IGHJ4*01 | 459 |
| 9 | gnl\|Fabrus\|VH1-18__IGHD6-6*01__IGHJ1*01 | 460 |
| 10 | gnl\|Fabrus\|VH1-2__IGHD1-1*01__IGHJ3*01 | 461 |
| 11 | gnl\|Fabrus\|VH1-24__IGHD1-7*01__IGHJ4*01 | 462 |
| 12 | gnl\|Fabrus\|VH1-24__IGHD2-15*01__IGHJ2*01 | 463 |
| 13 | gnl\|Fabrus\|VH1-24__IGHD3-10*01__IGHJ4*01 | 464 |
| 14 | gnl\|Fabrus\|VH1-24__IGHD3-16*01__IGHJ4*01 | 465 |
| 15 | gnl\|Fabrus\|VH1-24__IGHD4-23*01__IGHJ2*01 | 466 |
| 16 | gnl\|Fabrus\|VH1-24__IGHD5-12*01__IGHJ4*01 | 467 |
| 17 | gnl\|Fabrus\|VH1-24__IGHD5-18*01__IGHJ6*01 | 468 |
| 18 | gnl\|Fabrus\|VH1-24__IGHD6-19*01__IGHJ4*01 | 469 |
| 19 | gnl\|Fabrus\|VH1-3__IGHD2-15*01__IGHJ2*01 | 470 |
| 20 | gnl\|Fabrus\|VH1-3__IGHD2-2*01__IGHJ5*01 | 471 |
| 21 | gnl\|Fabrus\|VH1-3__IGHD3-9*01__IGHJ6*01 | 472 |
| 22 | gnl\|Fabrus\|VH1-3__IGHD4-23*01__IGHJ4*01 | 473 |
| 23 | gnl\|Fabrus\|VH1-3__IGHD5-18*01__IGHJ4*01 | 474 |
| 24 | gnl\|Fabrus\|VH1-3__IGHD6-6*01__IGHJ1*01 | 475 |
| 25 | gnl\|Fabrus\|VH1-3__IGHD7-27*01__IGHJ4*01 | 476 |
| 26 | gnl\|Fabrus\|VH1-45__IGHD1-26*01__IGHJ4*01 | 477 |
| 27 | gnl\|Fabrus\|VH1-45__IGHD2-15*01__IGHJ6*01 | 478 |
| 28 | gnl\|Fabrus\|VH1-45__IGHD2-8*01__IGHJ3*01 | 479 |
| 29 | gnl\|Fabrus\|VH1-45__IGHD3-10*01__IGHJ4*01 | 480 |
| 30 | gnl\|Fabrus\|VH1-45__IGHD3-16*01__IGHJ2*01 | 481 |
| 31 | gnl\|Fabrus\|VH1-45__IGHD4-23*01__IGHJ4*01 | 482 |
| 32 | gnl\|Fabrus\|VH1-45__IGHD5-24*01__IGHJ4*01 | 483 |
| 33 | gnl\|Fabrus\|VH1-45__IGHD6-19*01__IGHJ4*01 | 484 |
| 34 | gnl\|Fabrus\|VH1-45__IGHD7-27*01__IGHJ6*01 | 485 |
| 35 | gnl\|Fabrus\|VH1-46__IGHD1-26*01__IGHJ4*01 | 486 |
| 36 | gnl\|Fabrus\|VH1-46__IGHD2-15*01__IGHJ2*01 | 487 |
| 37 | gnl\|Fabrus\|VH1-46__IGHD3-10*01__IGHJ4*01 | 488 |
| 38 | gnl\|Fabrus\|VH1-46__IGHD4-17*01__IGHJ4*01 | 489 |
| 39 | gnl\|Fabrus\|VH1-46__IGHD5-18*01__IGHJ4*01 | 490 |
| 40 | gnl\|Fabrus\|VH1-46__IGHD6-13*01__IGHJ4*01 | 491 |
| 41 | gnl\|Fabrus\|VH1-46__IGHD6-6*01__IGHJ1*01 | 492 |
| 42 | gnl\|Fabrus\|VH1-46__IGHD7-27*01__IGHJ2*01 | 493 |

TABLE 22-continued

Exemplary Sequences Generated by DNA Compilation Software

| Number | Name | SEQ ID NO. |
|---|---|---|
| 43 | gnl\|Fabrus\|VH1-58__IGHD1-26*01__IGHJ4*01 | 494 |
| 44 | gnl\|Fabrus\|VH1-58__IGHD2-15*01__IGHJ2*01 | 495 |
| 45 | gnl\|Fabrus\|VH1-58__IGHD3-10*01__IGHJ6*01 | 496 |
| 46 | gnl\|Fabrus\|VH1-58__IGHD4-17*01__IGHJ6*01 | 497 |
| 47 | gnl\|Fabrus\|VH1-58__IGHD5-18*01__IGHJ4*01 | 498 |
| 48 | gnl\|Fabrus\|VH1-58__IGHD6-6*01__IGHJ1*01 | 499 |
| 49 | gnl\|Fabrus\|VH1-58__IGHD7-27*01__IGHJ5*01 | 500 |
| 50 | gnl\|Fabrus\|VH1-69__IGHD1-1*01__IGHJ6*01 | 501 |
| 51 | gnl\|Fabrus\|VH1-69__IGHD1-14*01__IGHJ4*01 | 502 |
| 52 | gnl\|Fabrus\|VH1-69__IGHD2-2*01__IGHJ4*01 | 503 |
| 53 | gnl\|Fabrus\|VH1-69__IGHD2-8*01__IGHJ6*01 | 504 |
| 54 | gnl\|Fabrus\|VH1-69__IGHD3-16*01__IGHJ4*01 | 505 |
| 55 | gnl\|Fabrus\|VH1-69__IGHD3-3*01__IGHJ4*01 | 506 |
| 56 | gnl\|Fabrus\|VH1-69__IGHD3-9*01__IGHJ6*01 | 507 |
| 57 | gnl\|Fabrus\|VH1-69__IGHD4-17*01__IGHJ4*01 | 508 |
| 58 | gnl\|Fabrus\|VH1-69__IGHD5-12*01__IGHJ4*01 | 509 |
| 59 | gnl\|Fabrus\|VH1-69__IGHD5-24*01__IGHJ6*01 | 510 |
| 60 | gnl\|Fabrus\|VH1-69__IGHD6-19*01__IGHJ4*01 | 511 |
| 61 | gnl\|Fabrus\|VH1-69__IGHD6-6*01__IGHJ1*01 | 512 |
| 62 | gnl\|Fabrus\|VH1-69__IGHD7-27*01__IGHJ4*01 | 513 |
| 63 | gnl\|Fabrus\|VH1-8__IGHD1-26*01__IGHJ4*01 | 514 |
| 64 | gnl\|Fabrus\|VH1-8__IGHD2-15*01__IGHJ6*01 | 515 |
| 65 | gnl\|Fabrus\|VH1-8__IGHD2-2*01__IGHJ6*01 | 516 |
| 66 | gnl\|Fabrus\|VH1-8__IGHD3-10*01__IGHJ4*01 | 517 |
| 67 | gnl\|Fabrus\|VH1-8__IGHD4-17*01__IGHJ4*01 | 518 |
| 68 | gnl\|Fabrus\|VH1-8__IGHD5-5*01__IGHJ4*01 | 519 |
| 69 | gnl\|Fabrus\|VH1-8__IGHD7-27*01__IGHJ4*01 | 520 |
| 70 | gnl\|Fabrus\|VH2-26__IGHD1-20*01__IGHJ4*01 | 521 |
| 71 | gnl\|Fabrus\|VH2-26__IGHD2-15*01__IGHJ2*01 | 522 |
| 72 | gnl\|Fabrus\|VH2-26__IGHD2-2*01__IGHJ4*01 | 523 |
| 73 | gnl\|Fabrus\|VH2-26__IGHD3-10*01__IGHJ4*01 | 524 |
| 74 | gnl\|Fabrus\|VH2-26__IGHD3-9*01__IGHJ6*01 | 525 |
| 75 | gnl\|Fabrus\|VH2-26__IGHD4-11*01__IGHJ4*01 | 526 |
| 76 | gnl\|Fabrus\|VH2-26__IGHD5-12*01__IGHJ4*01 | 527 |
| 77 | gnl\|Fabrus\|VH2-26__IGHD5-18*01__IGHJ4*01 | 528 |
| 78 | gnl\|Fabrus\|VH2-26__IGHD6-13*01__IGHJ4*01 | 529 |
| 79 | gnl\|Fabrus\|VH2-26__IGHD7-27*01__IGHJ4*01 | 530 |
| 80 | gnl\|Fabrus\|VH2-26__IGHD7-27*01__IGHJ4*01 | 531 |
| 81 | gnl\|Fabrus\|VH2-5__IGHD1-1*01__IGHJ5*01 | 532 |
| 82 | gnl\|Fabrus\|VH2-5__IGHD2-15*01__IGHJ6*01 | 533 |
| 83 | gnl\|Fabrus\|VH2-5__IGHD3-16*01__IGHJ4*01 | 534 |
| 84 | gnl\|Fabrus\|VH2-5__IGHD3-9*01__IGHJ6*01 | 535 |
| 85 | gnl\|Fabrus\|VH2-5__IGHD5-12*01__IGHJ4*01 | 536 |
| 86 | gnl\|Fabrus\|VH2-5__IGHD6-13*01__IGHJ4*01 | 537 |
| 87 | gnl\|Fabrus\|VH2-5__IGHD7-27*01__IGHJ2*01 | 538 |
| 88 | gnl\|Fabrus\|VH2-70__IGHD1-1*01__IGHJ2*01 | 539 |
| 89 | gnl\|Fabrus\|VH2-70__IGHD2-15*01__IGHJ2*01 | 540 |
| 90 | gnl\|Fabrus\|VH2-70__IGHD3-22*01__IGHJ4*01 | 541 |
| 91 | gnl\|Fabrus\|VH2-70__IGHD3-9*01__IGHJ6*01 | 542 |
| 92 | gnl\|Fabrus\|VH2-70__IGHD5-12*01__IGHJ4*01 | 543 |
| 93 | gnl\|Fabrus\|VH2-70__IGHD7-27*01__IGHJ2*01 | 544 |
| 94 | gnl\|Fabrus\|VH3-11__IGHD1-26*01__IGHJ4*01 | 545 |
| 95 | gnl\|Fabrus\|VH3-11__IGHD2-2*01__IGHJ6*01 | 546 |
| 96 | gnl\|Fabrus\|VH3-11__IGHD3-16*01__IGHJ4*01 | 547 |
| 97 | gnl\|Fabrus\|VH3-11__IGHD3-9*01__IGHJ6*01 | 548 |
| 98 | gnl\|Fabrus\|VH3-11__IGHD4-23*01__IGHJ5*01 | 549 |
| 99 | gnl\|Fabrus\|VH3-11__IGHD5-18*01__IGHJ4*01 | 550 |
| 100 | gnl\|Fabrus\|VH3-11__IGHD6-19*01__IGHJ6*01 | 551 |
| 101 | gnl\|Fabrus\|VH3-11__IGHD6-6*01__IGHJ1*01 | 552 |
| 102 | gnl\|Fabrus\|VH3-11__IGHD7-27*01__IGHJ4*01 | 553 |
| 103 | gnl\|Fabrus\|VH3-13__IGHD1-26*01__IGHJ4*01 | 554 |
| 104 | gnl\|Fabrus\|VH3-13__IGHD2-8*01__IGHJ5*01 | 555 |
| 105 | gnl\|Fabrus\|VH3-13__IGHD3-3*01__IGHJ1*01 | 556 |
| 106 | gnl\|Fabrus\|VH3-13__IGHD3-9*01__IGHJ6*01 | 557 |
| 107 | gnl\|Fabrus\|VH3-13__IGHD4-23*01__IGHJ5*01 | 558 |
| 108 | gnl\|Fabrus\|VH3-13__IGHD5-5*01__IGHJ4*01 | 559 |
| 109 | gnl\|Fabrus\|VH3-13__IGHD6-6*01__IGHJ1*01 | 560 |
| 110 | gnl\|Fabrus\|VH3-13__IGHD7-27*01__IGHJ5*01 | 561 |
| 111 | gnl\|Fabrus\|VH3-15__IGHD1-26*01__IGHJ4*01 | 562 |
| 112 | gnl\|Fabrus\|VH3-15__IGHD2-15*01__IGHJ1*01 | 563 |
| 113 | gnl\|Fabrus\|VH3-15__IGHD2-15*01__IGHJ6*01 | 564 |
| 114 | gnl\|Fabrus\|VH3-15__IGHD3-10*01__IGHJ4*01 | 565 |
| 115 | gnl\|Fabrus\|VH3-15__IGHD3-9*01__IGHJ2*01 | 566 |
| 116 | gnl\|Fabrus\|VH3-15__IGHD5-12*01__IGHJ4*01 | 567 |
| 117 | gnl\|Fabrus\|VH3-15__IGHD6-6*01__IGHJ1*01 | 568 |
| 118 | gnl\|Fabrus\|VH3-16__IGHD1-1*01__IGHJ1*01 | 569 |
| 119 | gnl\|Fabrus\|VH3-16__IGHD1-7*01__IGHJ6*01 | 570 |
| 120 | gnl\|Fabrus\|VH3-16__IGHD2-15*01__IGHJ2*01 | 571 |
| 121 | gnl\|Fabrus\|VH3-16__IGHD2-2*01__IGHJ2*01 | 572 |
| 122 | gnl\|Fabrus\|VH3-16__IGHD3-10*01__IGHJ4*01 | 573 |
| 123 | gnl\|Fabrus\|VH3-16__IGHD4-4*01__IGHJ2*01 | 574 |
| 124 | gnl\|Fabrus\|VH3-16__IGHD5-24*01__IGHJ4*01 | 575 |
| 125 | gnl\|Fabrus\|VH3-16__IGHD6-13*01__IGHJ4*01 | 576 |
| 126 | gnl\|Fabrus\|VH3-16__IGHD7-27*01__IGHJ2*01 | 577 |
| 127 | gnl\|Fabrus\|VH3-20__IGHD1-14*01__IGHJ4*01 | 578 |
| 128 | gnl\|Fabrus\|VH3-20__IGHD2-15*01__IGHJ2*01 | 579 |
| 129 | gnl\|Fabrus\|VH3-20__IGHD2-8*01__IGHJ4*01 | 580 |
| 130 | gnl\|Fabrus\|VH3-20__IGHD3-10*01__IGHJ4*01 | 581 |
| 131 | gnl\|Fabrus\|VH3-20__IGHD3-9*01__IGHJ6*01 | 582 |
| 132 | gnl\|Fabrus\|VH3-20__IGHD4-23*01__IGHJ4*01 | 583 |
| 133 | gnl\|Fabrus\|VH3-20__IGHD5-12*01__IGHJ4*01 | 584 |
| 134 | gnl\|Fabrus\|VH3-20__IGHD6-13*01__IGHJ4*01 | 585 |
| 135 | gnl\|Fabrus\|VH3-20__IGHD7-27*01__IGHJ2*01 | 586 |
| 136 | gnl\|Fabrus\|VH3-21__IGHD1-26*01__IGHJ4*01 | 587 |
| 137 | gnl\|Fabrus\|VH3-21__IGHD2-2*01__IGHJ5*01 | 588 |
| 138 | gnl\|Fabrus\|VH3-21__IGHD3-22*01__IGHJ4*01 | 589 |
| 139 | gnl\|Fabrus\|VH3-21__IGHD4-23*01__IGHJ5*01 | 590 |
| 140 | gnl\|Fabrus\|VH3-21__IGHD5-24*01__IGHJ5*01 | 591 |
| 141 | gnl\|Fabrus\|VH3-21__IGHD6-19*01__1GHJ1*01 | 592 |
| 142 | gnl\|Fabrus\|VH3-21__IGHD7-27*01__IGHJ4*01 | 593 |
| 143 | gnl\|Fabrus\|VH3-23__IGHD1-1*01__IGHJ1*01 | 594 |
| 144 | gnl\|Fabrus\|VH3-23__IGHD1-1*01__IGHJ4*01 | 595 |
| 145 | gnl\|Fabrus\|VH3-23__IGHD1-20*01__IGHJ3*01 | 596 |
| 146 | gnl\|Fabrus\|VH3-23__IGHD1-26*01__IGHJ4*01 | 597 |
| 147 | gnl\|Fabrus\|VH3-23__IGHD2-15*01__IGHJ4*01 | 598 |
| 148 | gnl\|Fabrus\|VH3-23__IGHD2-21*01__IGHJ1*01 | 599 |
| 149 | gnl\|Fabrus\|VH3-23__IGHD3-10*01__IGHJ4*01 | 600 |
| 150 | gnl\|Fabrus\|VH3-23__IGHD3-16*01__IGHJ4*01 | 601 |
| 151 | gnl\|Fabrus\|VH3-23__IGHD3-22*01__IGHJ4*01 | 602 |
| 152 | gnl\|Fabrus\|VH3-23__IGHD3-3*01__IGHJ5*01 | 603 |
| 153 | gnl\|Fabrus\|VH3-23__IGHD4-11*01__IGHJ4*01 | 604 |
| 154 | gnl\|Fabrus\|VH3-23__IGHD4-23*01__IGHJ2*01 | 605 |
| 155 | gnl\|Fabrus\|VH3-23__IGHD5-12*01__IGHJ4*01 | 606 |
| 156 | gnl\|Fabrus\|VH3-23__IGHD5-24*01__IGHJ1*01 | 607 |
| 157 | gnl\|Fabrus\|VH3-23__IGHD5-5*01__IGHJ4*01 | 608 |
| 158 | gnl\|Fabrus\|VH3-23__IGHD6-13*01__IGHJ4*01 | 609 |
| 159 | gnl\|Fabrus\|VH3-23__IGHD6-25*01__IGHJ2*01 | 610 |
| 160 | gnl\|Fabrus\|VH3-23__IGHD6-6*01__IGHJ1*01 | 611 |
| 161 | gnl\|Fabrus\|VH3-23__IGHD7-27*01__IGHJ4*01 | 612 |
| 162 | gnl\|Fabrus\|VH3-23__IGHD7-27*01__IGHJ6*01 | 613 |
| 163 | gnl\|Fabrus\|VH3-30__IGHD1-1*01__IGHJ6*01 | 614 |
| 164 | gnl\|Fabrus\|VH3-30__IGHD1-26*01__IGHJ1*01 | 615 |
| 165 | gnl\|Fabrus\|VH3-30__IGHD1-26*01__IGHJ4*01 | 616 |
| 166 | gnl\|Fabrus\|VH3-30__IGHD2-15*01__IGHJ2*01 | 617 |
| 167 | gnl\|Fabrus\|VH3-30__IGHD2-2*01__IGHJ6*01 | 618 |
| 168 | gnl\|Fabrus\|VH3-30__IGHD3-10*01__IGHJ1*01 | 619 |
| 169 | gnl\|Fabrus\|VH3-30__IGHD3-16*01__IGHJ6*01 | 620 |
| 170 | gnl\|Fabrus\|VH3-30__IGHD4-17*01__IGHJ4*01 | 621 |
| 171 | gnl\|Fabrus\|VH3-30__IGHD5-12*01__IGHJ4*01 | 622 |
| 172 | gnl\|Fabrus\|VH3-30__IGHD5-18*01__IGHJ1*01 | 623 |
| 173 | gnl\|Fabrus\|VH3-30__IGHD6-13*01__IGHJ4*01 | 624 |
| 174 | gnl\|Fabrus\|VH3-30__IGHD6-6*01__IGHJ1*01 | 625 |
| 175 | gnl\|Fabrus\|VH3-35__IGHD1-1*01__IGHJ2*01 | 626 |
| 176 | gnl\|Fabrus\|VH3-35__IGHD1-20*01__IGHJ6*01 | 627 |
| 177 | gnl\|Fabrus\|VH3-35__IGHD2-15*01__IGHJ2*01 | 628 |
| 178 | gnl\|Fabrus\|VH3-35__IGHD2-21*01__IGHJ6*01 | 629 |
| 179 | gnl\|Fabrus\|VH3-35__IGHD3-10*01__IGHJ4*01 | 630 |
| 180 | gnl\|Fabrus\|VH3-35__IGHD3-9*01__IGHJ6*01 | 631 |
| 181 | gnl\|Fabrus\|VH3-35__IGHD5-12*01__IGHJ4*01 | 632 |
| 182 | gnl\|Fabrus\|VH3-35__IGHD6-13*01__IGHJ4*01 | 633 |
| 183 | gnl\|Fabrus\|VH3-35__IGHD7-27*01__IGHJ1*01 | 634 |
| 184 | gnl\|Fabrus\|VH3-38__IGHD1-14*01__IGHJ5*01 | 635 |
| 185 | gnl\|Fabrus\|VH3-38__IGHD1-20*01__IGHJ6*01 | 636 |
| 186 | gnl\|Fabrus\|VH3-38__IGHD2-15*01__IGHJ6*01 | 637 |
| 187 | gnl\|Fabrus\|VH3-38__IGHD2-2*01__IGHJ1*01 | 638 |
| 188 | gnl\|Fabrus\|VH3-38__IGHD3-10*01__IGHJ4*01 | 639 |
| 189 | gnl\|Fabrus\|VH3-38__IGHD3-16*01__IGHJ1*01 | 640 |
| 190 | gnl\|Fabrus\|VH3-38__IGHD4-17*01__IGHJ2*01 | 641 |
| 191 | gnl\|Fabrus\|VH3-38__IGHD5-24*01__IGHJ3*01 | 642 |
| 192 | gnl\|Fabrus\|VH3-38__IGHD6-6*01__IGHJ1*01 | 643 |

TABLE 22-continued

Exemplary Sequences Generated by DNA Compilation Software

| Number | Name | SEQ ID NO. |
|---|---|---|
| 193 | gnl\|Fabrus\|VH3-38__IGHD7-27*01__IGHJ6*01 | 644 |
| 194 | gnl\|Fabrus\|VH3-43__IGHD1-26*01__IGHJ5*01 | 645 |
| 195 | gnl\|Fabrus\|VH3-43__IGHD1-7*01__IGHJ6*01 | 646 |
| 196 | gnl\|Fabrus\|VH3-43__IGHD2-2*01__IGHJ3*01 | 647 |
| 197 | gnl\|Fabrus\|VH3-43__IGHD2-21*01__IGHJ6*01 | 648 |
| 198 | gnl\|Fabrus\|VH3-43__IGHD3-16*01__IGHJ6*01 | 649 |
| 199 | gnl\|Fabrus\|VH3-43__IGHD3-22*01__IGHJ4*01 | 650 |
| 200 | gnl\|Fabrus\|VH3-43__IGHD4-23*01__IGHJ3*01 | 651 |
| 201 | gnl\|Fabrus\|VH3-43__IGHD5-18*01__IGHJ5*01 | 652 |
| 202 | gnl\|Fabrus\|VH3-43__IGHD6-13*01__IGHJ4*01 | 653 |
| 203 | gnl\|Fabrus\|VH3-43__IGHD7-27*01__IGHJ1*01 | 654 |
| 204 | gnl\|Fabrus\|VH3-48__IGHD6-6*01__IGHJ1*01 | 655 |
| 205 | gnl\|Fabrus\|VH3-49__IGHD1-26*01__IGHJ4*01 | 656 |
| 206 | gnl\|Fabrus\|VH3-49__IGHD1-7*01__IGHJ6*01 | 657 |
| 207 | gnl\|Fabrus\|VH3-49__IGHD2-2*01__IGHJ6*01 | 658 |
| 208 | gnl\|Fabrus\|VH3-49__IGHD2-8*01__IGHJ4*01 | 659 |
| 209 | gnl\|Fabrus\|VH3-49__IGHD3-22*01__IGHJ4*01 | 660 |
| 210 | gnl\|Fabrus\|VH3-49__IGHD3-9*01__IGHJ6*01 | 661 |
| 211 | gnl\|Fabrus\|VH3-49__IGHD5-18*01__IGHJ4*01 | 662 |
| 212 | gnl\|Fabrus\|VH3-49__IGHD6-13*01__IGHJ1*01 | 663 |
| 213 | gnl\|Fabrus\|VH3-49__IGHD7-27*01__IGHJ1*01 | 664 |
| 214 | gnl\|Fabrus\|VH3-53__IGHD1-14*01__IGHJ6*01 | 665 |
| 215 | gnl\|Fabrus\|VH3-53__IGHD1-7*01__IGHJ1*01 | 666 |
| 216 | gnl\|Fabrus\|VH3-53__IGHD2-2*01__IGHJ2*01 | 667 |
| 217 | gnl\|Fabrus\|VH3-53__IGHD3-22*01__IGHJ3*01 | 668 |
| 218 | gnl\|Fabrus\|VH3-53__IGHD4-23*01__IGHJ1*01 | 669 |
| 219 | gnl\|Fabrus\|VH3-53__IGHD5-5*01__IGHJ4*01 | 670 |
| 220 | gnl\|Fabrus\|VH3-53__IGHD6-13*01__IGHJ4*01 | 671 |
| 221 | gnl\|Fabrus\|VH3-53__IGHD7-27*01__IGHJ4*01 | 672 |
| 222 | gnl\|Fabrus\|VH3-64__IGHD1-26*01__IGHJ4*01 | 673 |
| 223 | gnl\|Fabrus\|VH3-64__IGHD1-7*01__IGHJ6*01 | 674 |
| 224 | gnl\|Fabrus\|VH3-64__IGHD2-2*01__IGHJ5*01 | 675 |
| 225 | gnl\|Fabrus\|VH3-64__IGHD3-3*01__IGHJ4*01 | 676 |
| 226 | gnl\|Fabrus\|VH3-64__IGHD4-17*01__IGHJ4*01 | 677 |
| 227 | gnl\|Fabrus\|VH3-64__IGHD5-12*01__IGHJ4*01 | 678 |
| 228 | gnl\|Fabrus\|VH3-64__IGHD6-19*01__IGHJ1*01 | 679 |
| 229 | gnl\|Fabrus\|VH3-64__IGHD7-27*01__IGHJ1*01 | 680 |
| 230 | gnl\|Fabrus\|VH3-66__IGHD6-6*01__IGHJ1*01 | 681 |
| 231 | gnl\|Fabrus\|VH3-7__IGHD1-20*01__IGHJ3*01 | 682 |
| 232 | gnl\|Fabrus\|VH3-7__IGHD1-7*01__IGHJ6*01 | 683 |
| 233 | gnl\|Fabrus\|VH3-7__IGHD2-21*01__IGHJ5*01 | 684 |
| 234 | gnl\|Fabrus\|VH3-7__IGHD2-8*01__IGHJ6*01 | 685 |
| 235 | gnl\|Fabrus\|VH3-7__IGHD3-22*01__IGHJ3*01 | 686 |
| 236 | gnl\|Fabrus\|VH3-7__IGHD3-9*01__IGHJ6*01 | 687 |
| 237 | gnl\|Fabrus\|VH3-7__IGHD4-17*01__IGHJ4*01 | 688 |
| 238 | gnl\|Fabrus\|VH3-7__IGHD5-12*01__IGHJ4*01 | 689 |
| 239 | gnl\|Fabrus\|VH3-7__IGHD5-24*01__IGHJ4*01 | 690 |
| 240 | gnl\|Fabrus\|VH3-7__IGHD6-19*01__IGHJ6*01 | 691 |
| 241 | gnl\|Fabrus\|VH3-7__IGHD6-6*01__IGHJ1*01 | 692 |
| 242 | gnl\|Fabrus\|VH3-7__IGHD7-27*01__IGHJ2*01 | 693 |
| 243 | gnl\|Fabrus\|VH3-72__IGHD1-1*01__IGHJ4*01 | 694 |
| 244 | gnl\|Fabrus\|VH3-72__IGHD2-15*01__IGHJ1*01 | 695 |
| 245 | gnl\|Fabrus\|VH3-72__IGHD3-22*01__IGHJ4*01 | 696 |
| 246 | gnl\|Fabrus\|VH3-72__IGHD3-9*01__IGHJ6*01 | 697 |
| 247 | gnl\|Fabrus\|VH3-72__IGHD4-23*01__IGHJ2*01 | 698 |
| 248 | gnl\|Fabrus\|VH3-72__IGHD5-18*01__IGHJ4*01 | 699 |
| 249 | gnl\|Fabrus\|VH3-72__IGHD5-24*01__IGHJ6*01 | 700 |
| 250 | gnl\|Fabrus\|VH3-72__IGHD6-6*01__IGHJ1*01 | 701 |
| 251 | gnl\|Fabrus\|VH3-72__IGHD7-27*01__IGHJ2*01 | 702 |
| 252 | gnl\|Fabrus\|VH3-73__IGHD1-1*01__IGHJ5*01 | 703 |
| 253 | gnl\|Fabrus\|VH3-73__IGHD2-8*01__IGHJ2*01 | 704 |
| 254 | gnl\|Fabrus\|VH3-73__IGHD3-22*01__IGHJ4*01 | 705 |
| 255 | gnl\|Fabrus\|VH3-73__IGHD3-9*01__IGHJ6*01 | 706 |
| 256 | gnl\|Fabrus\|VH3-73__IGHD4-11*01__IGHJ6*01 | 707 |
| 257 | gnl\|Fabrus\|VH3-73__IGHD4-23*01__IGHJ5*01 | 708 |
| 258 | gnl\|Fabrus\|VH3-73__IGHD5-12*01__IGHJ4*01 | 709 |
| 259 | gnl\|Fabrus\|VH3-73__IGHD6-19*01__IGHJ1*01 | 710 |
| 260 | gnl\|Fabrus\|VH3-73__IGHD7-27*01__IGHJ5*01 | 711 |
| 261 | gnl\|Fabrus\|VH3-74__IGHD1-1*01__IGHJ6*01 | 712 |
| 262 | gnl\|Fabrus\|VH3-74__IGHD1-26*01__IGHJ4*01 | 713 |
| 263 | gnl\|Fabrus\|VH3-74__IGHD2-2*01__IGHJ5*01 | 714 |
| 264 | gnl\|Fabrus\|VH3-74__IGHD3-22*01__IGHJ5*01 | 715 |
| 265 | gnl\|Fabrus\|VH3-74__IGHD4-17*01__IGHJ1*01 | 716 |
| 266 | gnl\|Fabrus\|VH3-74__IGHD5-12*01__IGHJ4*01 | 717 |
| 267 | gnl\|Fabrus\|VH3-74__IGHD6-6*01__IGHJ1*01 | 718 |
| 268 | gnl\|Fabrus\|VH3-74__IGHD7-27*01__IGHJ4*01 | 719 |
| 269 | gnl\|Fabrus\|VH3-9__IGHD1-1*01__IGHJ6*01 | 720 |
| 270 | gnl\|Fabrus\|VH3-9__IGHD1-7*01__IGHJ5*01 | 721 |
| 271 | gnl\|Fabrus\|VH3-9__IGHD2-2*01__IGHJ4*01 | 722 |
| 272 | gnl\|Fabrus\|VH3-9__IGHD3-16*01__IGHJ6*01 | 723 |
| 273 | gnl\|Fabrus\|VH3-9__IGHD3-22*01__IGHJ4*01 | 724 |
| 274 | gnl\|Fabrus\|VH3-9__IGHD4-11*01__IGHJ4*01 | 725 |
| 275 | gnl\|Fabrus\|VH3-9__IGHD5-24*01__IGHJ1*01 | 726 |
| 276 | gnl\|Fabrus\|VH3-9__IGHD6-13*01__IGHJ4*01 | 727 |
| 277 | gnl\|Fabrus\|VH3-9__IGHD6-25*01__IGHJ6*01 | 728 |
| 278 | gnl\|Fabrus\|VH3-9__IGHD7-27*01__IGHJ2*01 | 729 |
| 279 | gnl\|Fabrus\|VH4-28__IGHD1-20*01__IGHJ1*01 | 730 |
| 280 | gnl\|Fabrus\|VH4-28__IGHD1-7*01__IGHJ6*01 | 731 |
| 281 | gnl\|Fabrus\|VH4-28__IGHD2-15*01__IGHJ6*01 | 732 |
| 282 | gnl\|Fabrus\|VH4-28__IGHD3-16*01__IGHJ2*01 | 733 |
| 283 | gnl\|Fabrus\|VH4-28__IGHD3-9*01__IGHJ6*01 | 734 |
| 284 | gnl\|Fabrus\|VH4-28__IGHD4-4*01__IGHJ4*01 | 735 |
| 285 | gnl\|Fabrus\|VH4-28__IGHD5-5*01__IGHJ1*01 | 736 |
| 286 | gnl\|Fabrus\|VH4-28__IGHD6-13*01__IGHJ4*01 | 737 |
| 287 | gnl\|Fabrus\|VH4-28__IGHD7-27*01__IGHJ1*01 | 738 |
| 288 | gnl\|Fabrus\|VH4-31__IGHD1-26*01__IGHJ2*01 | 739 |
| 289 | gnl\|Fabrus\|VH4-31__IGHD2-15*01__IGHJ2*01 | 740 |
| 290 | gnl\|Fabrus\|VH4-31__IGHD2-2*01__IGHJ6*01 | 741 |
| 291 | gnl\|Fabrus\|VH4-31__IGHD3-10*01__IGHJ4*01 | 742 |
| 292 | gnl\|Fabrus\|VH4-31__IGHD3-9*01__IGHJ6*01 | 743 |
| 293 | gnl\|Fabrus\|VH4-31__IGHD4-17*01__IGHJ5*01 | 744 |
| 294 | gnl\|Fabrus\|VH4-31__IGHD5-12*01__IGHJ4*01 | 745 |
| 295 | gnl\|Fabrus\|VH4-31__IGHD6-13*01__IGHJ4*01 | 746 |
| 296 | gnl\|Fabrus\|VH4-31__IGHD6-6*01__IGHJ1*01 | 747 |
| 297 | gnl\|Fabrus\|VH4-31__IGHD7-27*01__IGHJ5*01 | 748 |
| 298 | gnl\|Fabrus\|VH4-34__IGHD1-7*01__IGHJ4*01 | 749 |
| 299 | gnl\|Fabrus\|VH4-34__IGHD2-2*01__IGHJ4*01 | 750 |
| 300 | gnl\|Fabrus\|VH4-34__IGHD3-16*01__IGHJ4*01 | 751 |
| 301 | gnl\|Fabrus\|VH4-34__IGHD3-22*01__IGHJ6*01 | 752 |
| 302 | gnl\|Fabrus\|VH4-34__IGHD4-17*01__IGHJ4*01 | 753 |
| 303 | gnl\|Fabrus\|VH4-34__IGHD5-12*01__IGHJ4*01 | 754 |
| 304 | gnl\|Fabrus\|VH4-34__IGHD6-13*01__IGHJ4*01 | 755 |
| 305 | gnl\|Fabrus\|VH4-34__IGHD6-25*01__IGHJ6*01 | 756 |
| 306 | gnl\|Fabrus\|VH4-34__IGHD6-6*01__IGHJ6*01 | 757 |
| 307 | gnl\|Fabrus\|VH4-34__IGHD7-27*01__IGHJ4*01 | 758 |
| 308 | gnl\|Fabrus\|VH4-39__IGHD1-14*01__IGHJ1*01 | 759 |
| 309 | gnl\|Fabrus\|VH4-39__IGHD1-20*01__IGHJ6*01 | 760 |
| 310 | gnl\|Fabrus\|VH4-39__IGHD2-21*01__IGHJ3*01 | 761 |
| 311 | gnl\|Fabrus\|VH4-39__IGHD3-10*01__IGHJ4*01 | 762 |
| 312 | gnl\|Fabrus\|VH4-39__IGHD3-16*01__IGHJ2*01 | 763 |
| 313 | gnl\|Fabrus\|VH4-39__IGHD3-9*01__IGHJ6*01 | 764 |
| 314 | gnl\|Fabrus\|VH4-39__IGHD4-23*01__IGHJ2*01 | 765 |
| 315 | gnl\|Fabrus\|VH4-39__IGHD5-12*01__IGHJ4*01 | 766 |
| 316 | gnl\|Fabrus\|VH4-39__IGHD6-6*01__IGHJ1*01 | 767 |
| 317 | gnl\|Fabrus\|VH4-4__IGHD1-20*01__IGHJ3*01 | 768 |
| 318 | gnl\|Fabrus\|VH4-4__IGHD2-8*01__IGHJ4*01 | 769 |
| 319 | gnl\|Fabrus\|VH4-4__IGHD3-22*01__IGHJ2*01 | 770 |
| 320 | gnl\|Fabrus\|VH4-4__IGHD4-23*01__IGHJ4*01 | 771 |
| 321 | gnl\|Fabrus\|VH4-4__IGHD5-12*01__IGHJ5*01 | 772 |
| 322 | gnl\|Fabrus\|VH4-4__IGHD6-6*01__IGHJ4*01 | 773 |
| 323 | gnl\|Fabrus\|VH4-4__IGHD7-27*01__IGHJ6*01 | 774 |
| 324 | gnl\|Fabrus\|VH4-59__IGHD6-25*01__IGHJ3*01 | 775 |
| 325 | gnl\|Fabrus\|VH5-51__IGHD1-14*01__IGHJ4*01 | 776 |
| 326 | gnl\|Fabrus\|VH5-51__IGHD1-26*01__IGHJ6*01 | 777 |
| 327 | gnl\|Fabrus\|VH5-51__IGHD2-8*01__IGHJ4*01 | 778 |
| 328 | gnl\|Fabrus\|VH5-51__IGHD3-10*01__IGHJ6*01 | 779 |
| 329 | gnl\|Fabrus\|VH5-51__IGHD3-3*01__IGHJ4*01 | 780 |
| 330 | gnl\|Fabrus\|VH5-51__IGHD4-17*01__IGHJ4*01 | 781 |
| 331 | gnl\|Fabrus\|VH5-51__IGHD5-18*01>3__IGHJ4*01 | 782 |
| 332 | gnl\|Fabrus\|VH5-51__IGHD5-18*01>1__IGHJ4*01 | 783 |
| 333 | gnl\|Fabrus\|VH5-51__IGHD6-25*01__IGHJ4*01 | 784 |
| 334 | gnl\|Fabrus\|VH5-51__IGHD7-27*01__IGHJ4*01 | 785 |
| 335 | gnl\|Fabrus\|VH6-1__IGHD1-1*01__IGHJ4*01 | 786 |
| 336 | gnl\|Fabrus\|VH6-1__IGHD1-20*01__IGHJ6*01 | 787 |
| 337 | gnl\|Fabrus\|VH6-1__IGHD2-15*01__IGHJ6*01 | 788 |
| 338 | gnl\|Fabrus\|VH6-1__IGHD2-21*01__IGHJ6*01 | 789 |
| 339 | gnl\|Fabrus\|VH6-1__IGHD3-16*01__IGHJ5*01 | 790 |
| 340 | gnl\|Fabrus\|VH6-1__IGHD3-3*01__IGHJ4*01 | 791 |
| 341 | gnl\|Fabrus\|VH6-1__IGHD4-11*01__IGHJ6*01 | 792 |
| 342 | gnl\|Fabrus\|VH6-1__IGHD4-23*01__IGHJ4*01 | 793 |

TABLE 22-continued

Exemplary Sequences Generated by DNA Compilation Software

| Number | Name | SEQ ID NO. |
|---|---|---|
| 343 | gnl\|Fabrus\|VH6-1__IGHD5-5*01__IGHJ4*01 | 794 |
| 344 | gnl\|Fabrus\|VH6-1__IGHD6-13*01__IGHJ4*01 | 795 |
| 345 | gnl\|Fabrus\|VH6-1__IGHD6-25*01__IGHJ6*01 | 796 |
| 346 | gnl\|Fabrus\|VH6-1__IGHD7-27*01__IGHJ4*01 | 797 |
| 347 | gnl\|Fabrus\|VH7-81__IGHD1-14*01__IGHJ4*01 | 798 |
| 348 | gnl\|Fabrus\|VH7-81__IGHD2-21*01__IGHJ2*01 | 799 |
| 349 | gnl\|Fabrus\|VH7-81__IGHD2-21*01__IGHJ6*01 | 800 |
| 350 | gnl\|Fabrus\|VH7-81__IGHD3-16*01__IGHJ6*01 | 801 |
| 351 | gnl\|Fabrus\|VH7-81__IGHD4-23*01__IGHJ1*01 | 802 |
| 352 | gnl\|Fabrus\|VH7-81__IGHD5-12*01__IGHJ6*01 | 803 |
| 353 | gnl\|Fabrus\|VH7-81__IGHD6-25*01__IGHJ4*01 | 804 |
| 354 | gnl\|Fabrus\|VH7-81__IGHD7-27*01__IGHJ4*01 | 805 |
| Light Chain | | |
| 1 | gnl\|Fabrus\|A14__IGKJ1*01 | 806 |
| 2 | gnl\|Fabrus\|A17__IGKJ1*01 | 807 |
| 3 | gnl\|Fabrus\|A2__IGKJ1*01 | 808 |
| 4 | gnl\|Fabrus\|A20__IGKJ1*01 | 809 |
| 5 | gnl\|Fabrus\|A23__IGKJ1*01 | 810 |
| 6 | gnl\|Fabrus\|A26__IGKJ1*01 | 811 |
| 7 | gnl\|Fabrus\|A27__IGKJ1*01 | 812 |
| 8 | gnl\|Fabrus\|A27__IGKJ3*01 | 813 |
| 9 | gnl\|Fabrus\|A30__IGKJ1*01 | 814 |
| 10 | gnl\|Fabrus\|B2__IGKJ1*01 | 815 |
| 11 | gnl\|Fabrus\|B2__IGKJ3*01 | 816 |
| 12 | gnl\|Fabrus\|B3__IGKJ1*01 | 817 |
| 14 | gnl\|Fabrus\|L11__IGKJ1*01 | 819 |
| 15 | gnl\|Fabrus\|L12__IGKJ1*01 | 820 |
| 16 | gnl\|Fabrus\|L14__IGKJ1*01 | 821 |
| 17 | gnl\|Fabrus\|L2__IGKJ1*01 | 822 |
| 18 | gnl\|Fabrus\|L22__IGKJ3*01 | 823 |
| 19 | gnl\|Fabrus\|L23__IGKJ1*01 | 824 |
| 20 | gnl\|Fabrus\|L25__IGKJ1*01 | 825 |
| 21 | gnl\|Fabrus\|L25__IGKJ3*01 | 826 |
| 22 | gnl\|Fabrus\|L4/18a__IGKJ1*01 | 827 |
| 23 | gnl\|Fabrus\|L5__IGKJ1*01 | 828 |
| 24 | gnl\|Fabrus\|L6__IGKJ1*01 | 829 |
| 25 | gnl\|Fabrus\|L8__IGKJ1*01 | 830 |
| 26 | gnl\|Fabrus\|L9__IGKJ2*01 | 831 |
| 27 | gnl\|Fabrus\|O1__IGKJ1*01 | 832 |
| 28 | gnl\|Fabrus\|O12__IGKJ1*01 | 833 |
| 29 | gnl\|Fabrus\|O18__IGKJ1*01 | 834 |
| 31 | gnl\|Fabrus\|V1-11__IGLJ2*01 | 836 |
| 32 | gnl\|Fabrus\|V1-13__IGLJ5*01 | 837 |
| 33 | gnl\|Fabrus\|V1-16__IGLJ6*01 | 838 |
| 34 | gnl\|Fabrus\|V1-18__IGLJ2*01 | 839 |
| 35 | gnl\|Fabrus\|V1-2__IGLJ7*01 | 840 |
| 36 | gnl\|Fabrus\|V1-20__IGLJ6*01 | 841 |
| 37 | gnl\|Fabrus\|V1-3__IGLJ1*01 | 842 |
| 38 | gnl\|Fabrus\|V1-4__IGLJ4*01 | 843 |
| 39 | gnl\|Fabrus\|V1-5__IGLJ2*01 | 844 |
| 40 | gnl\|Fabrus\|V1-7__IGLJ1*01 | 845 |
| 41 | gnl\|Fabrus\|V1-9__IGLJ6*01 | 846 |
| 42 | gnl\|Fabrus\|V2-1__IGLJ6*01 | 847 |
| 43 | gnl\|Fabrus\|V2-11__IGLJ7*01 | 848 |
| 44 | gnl\|Fabrus\|V2-13__IGLJ2*01 | 849 |
| 45 | gnl\|Fabrus\|V2-14__IGLJ4*01 | 850 |
| 46 | gnl\|Fabrus\|V2-15__IGLJ7*01 | 851 |
| 47 | gnl\|Fabrus\|V2-17__IGLJ2*01 | 852 |
| 48 | gnl\|Fabrus\|V2-19__IGLJ4*01 | 853 |
| 49 | gnl\|Fabrus\|V2-6__IGLJ4*01 | 854 |
| 50 | gnl\|Fabrus\|V2-7__IGLJ2*01 | 855 |
| 51 | gnl\|Fabrus\|V2-7__IGLJ7*01 | 856 |
| 52 | gnl\|Fabrus\|V2-8__IGLJ6*01 | 857 |
| 53 | gnl\|Fabrus\|V3-2__IGLJ4*01 | 858 |
| 54 | gnl\|Fabrus\|V3-3__IGLJ7*01 | 859 |
| 55 | gnl\|Fabrus\|V3-4__IGLJ1*01 | 860 |
| 56 | gnl\|Fabrus\|V4-1__IGLJ4*01 | 861 |
| 57 | gnl\|Fabrus\|V4-2__IGLJ4*01 | 862 |
| 58 | gnl\|Fabrus\|V4-3__IGLJ4*01 | 863 |
| 59 | gnl\|Fabrus\|V4-4__IGLJ5*01 | 864 |
| 60 | gnl\|Fabrus\|V4-6__IGLJ4*01 | 865 |
| 61 | gnl\|Fabrus\|V5-4__IGLJ2*01 | 866 |
| 62 | gnl\|Fabrus\|V5-6__IGLJ1*01 | 867 |

Example 7

Comparison of Fab Secretion by Different Leader Sequences

In this Example, the effect of different leader sequences on expression of encoded Fabs was assessed. In order to assure properly folded Fab proteins, disulfide bonds must form in an oxidizing environment and therefore it is necessary to translocate the Fab proteins into the periplasm by using a pathway such as Sec, SRP and TAT. The SRP pathway does not require unfolding of any proteins. SRP leader sequences are shown in Table 23.

TABLE 23

SRP Leader Sequences

| Name | SEQ ID NO. | Sequence |
|---|---|---|
| DsbA | 5 | MKKIWLALAGLVLAFSASA |
| SfmC | 6 | MMTKIKLLMLIIFYLIISASAHA |
| TolB | 7 | MKQALRVAFGFLILWASVLHA |
| TorT | 8 | MRVLLFLLLSLRMLPAFS |

Plasmid A (SEQ ID NO:1) and plasmid C (SEQ ID NO:3) were modified to contain either a DsbA leader sequence (SEQ ID NO:5) or a mutant DsbA leader sequence (SEQ ID NO:965) and a ribosomal binding site (RBS) variation. Overlap PCR was performed using three forward primers containing RBS variations and the sequence corresponding to the N-terminus of DsbA (set forth in SEQ ID NOS:966-968) and two reverse primers corresponding to the C-terminus of either DsbA or mutant DsbA (set forth in SEQ ID NOS:969-970). The PCR resulted in six different leader sequences (Table 24). These leader sequences were then inserted into Plasmid A and Plasmid C between EcoRI and NcoI sites upstream of the start codon, ATG. Plasmids A and C containing the DsbA leader sequence with the RBS variations are set forth in SEQ ID NO:1015-1017 and 1021-1023, respectively. Plasmids A and C containing the mutant DsbA leader sequence with the RBS variations are set forth in SEQ ID NO:1018-1020 and 1024-1026, respectively.

TABLE 24

DsbA and mutant DsbA leader sequences with RBS variations

| Name | Leader Sequence | SEQ ID NO. |
|---|---|---|
| DS1 | GAATTCTAAGGAGGTTTCACCATGAAAAAGATTTGGCTGGCGCTGGCTGGTTTAGTTTTAGC GTTTAGC GCC ATG G | 971 |

TABLE 24-continued

DsbA and mutant DsbA leader sequences with RBS variations

| Name | Leader Sequence | SEQ ID NO. |
|---|---|---|
| DS2 | GAATTCTAAGGAGTATTCACCATGAAAAAGATTTGGCTGGCGCTGGCTGGTTTAGTTTTAGC GTTTAGC GCC ATG G | 972 |
| DS3 | GAATTCTTAGGATTATTCACCATGAAAAAGATTTGGCTGGCGCTGGCTGGTTTAGTTTTAGCG TTTAGC GCC ATG G | 973 |
| DM1 | GAATTCTAAGGAGGTTTCACCATGAAAAAGATTTGGCTGGCGCTGGCTGGTTTAGTTTTAGC GTTTAGCGCATCG GCG GCC ATG GCA | 974 |
| DM2 | GAATTCTAAGGAGTATTCACCATGAAAAAGATTTGGCTGGCGCTGGCTGGTTTAGTTTTAGC GTTTAGCGCATCG GCG GCC ATG GCA | 975 |
| DM3 | GAATTCTTAGGATTATTCACCATGAAAAAGATTTGGCTGGCGCTGGCTGGTTTAGTTTTAGCG TTTAGCGCATCG GCG GCC ATG GCA | 976 |

To assess the effect of the different leader sequences on the expression of a Fab antibody, expression of Rituxan was assessed. Rituxan heavy chain (SEQ ID NO:453) was cloned in-frame to the $C_H$ sequence present on the respective Plasmid A vector and Rituxan light chain (SEQ ID NO:835) was cloned in-frame to the C sequence present in the respective Plasmid C vector. Briefly, the VH and V chains were cloned into the Plasmid A or C vectors (containing an STII leader sequence, a DsbA leader sequence or a mutant DsbA leader sequence) by digestion of the plasmids with NheI and NcoI (for the heavy chain DNA) or with NcoI and BsiWI (for the light chain DNA) followed by ligation. Plasmids encoding a heavy and light chain were co-transformed into LMG194 cells as described in Example 8 below and grown for 36 hours at 20° C. in terrific broth (TB) medium in the presence of 0.4% glucose and 0.008% arabinose. Expressed Fabs were extracted from the whole cells using Bugbuster® (Novagen), and purified using a $Ni^{2+}$ affinity column (EMD), and analyzed by SDS-PAGE followed by Western Blot. The results show that in the absence of an inducer little to no protein was expressed. Upon induction, expression of the Fabs under the control of the DsbA leader sequence (for each of the three RBS variations) was equal to expression under the control of the STII leader sequence. Mutated DsbA resulted in lower expression. There was no significant difference in expression among the various RBS variations of the DsbA leader sequence.

Example 8

Cloning and Co-Transformation of Synthesized Variable Heavy and Light Chains

In this Example, a Fab library was created by cloning heavy or light chain DNA into their respective Plasmids followed by co-transformation and protein growth/purification. Following synthesis of the DNA molecules generated from the Sequence Compilation Software as described in Example 6, the DNA molecules were cloned into plasmids containing constant heavy or light chains as appropriate for co-transformation and expression of combinatorial Fabs. Plasmid A (SEQ ID NO:1) and plasmid D (SEQ ID NO:2) contain heavy chain constant regions sequences. Plasmid C (SEQ ID NO:3) contains a kappa light chain constant region sequence and Plasmid E (SEQ ID NO:4) contains a lambda light chain constant region sequence.

Synthetic recombined nucleic acid encoding a variable heavy chain were digested with Nhe I and Nco I and ligated into Plasmid A with a StII leader sequence using standard molecular techniques. Synthetic recombined nucleic acid encoding a variable kappa light chain were digested with NcoI and BsiWI and synthetic recombined nucleic acid encoding a variable lambda chain were digested with NcoI and AvrII, and were ligated into Plasmid C or Plasmid E, respectively, with a StII leader sequence, using standard molecular biology techniques.

Plasmid A and one of either Plasmid C or Plasmid E, each containing various combinations of variable heavy and light chains, were co-transformed into E. coli. The process was repeated for all combinations of heavy and light chains. Briefly, plasmid A (encoding a Fab heavy chain) and plasmid C or Plasmid E (encoding a Fab light chain) were resuspended separately in TE buffer to a final concentration of 1 ng/μl. One (1) μL of heavy chain plasmid and 1 μL of light chain plasmid were combined in a PCR tube or a PCR plate and were mixed with 20 μL ice cold LMG194 competent cells. The transformation reaction was incubated on ice for 10 minutes followed by heat shock in a preheated PCR block at 42° C. for 45 seconds. The tube was then placed on ice for an additional 2 minutes followed by addition of 200 μL SOC medium. The cells were allowed to recover for 1.5 hours at 37° C. A 100 μL aliquot of the transformation culture was used to inoculate 0.9 mL LB (Luria-Bertani Broth) containing 0.4% (w/v) glucose, 17 μg/mL kanamycin (Sigma Aldrich) and 34 μg/mL chloramphenicol (Sigma Aldrich). The culture was grown at 30° C. with vigorous shaking for 20 hours. The transformation culture was grown and purified using the Piccolo™ system as described in Example 9.

Example 9

High Throughput Growth and Purification of Fab Libraries

In this Example, Fab libraries are generated and purified using high throughput techniques. High throughput transformation of pairs of heavy chains (plasmid A) and light chains (plasmid C or E) was performed as described in Example 8, except that a 96-well PCR plate was used instead of individual PCR tubes. After transformation, the cells were grown overnight in 2 ml deep well 96-well plates (VWR) block covered with breathable tape. The overnight culture was used directly for inoculation in Piccolo™ (Wollerton et al. (2006) JALA, 11:291-303.)

High throughput, parallel expression and purification of antibody Fab fragments was performed using Piccolo™ (The Automation Partnership (TAP)), which automates protein expression and purification. The expression and purification parameters for Piccolo™ were prepared using Run Composer software (TAP). A 'Strain File' was generated mapping the location of each clone in the seed culture plate. This was submitted to the Run Composer software and the basic machine settings were set as follows: Pre-induction Incubator set at 30° C.; Expression Incubator 1 set at 16° C.; Centrifuge set at 6° C. and 5000×g; Media Pump 1 primed with TB (Terrific Broth; per liter contains 12 g tryptone, 24 g yeast extract, 9.4 g potassium phosphate, dibasic, and 2.2 g potassium phosphate, monobasic) (EMD Biosciences; catalog No. 71754), 50 µg/mL kanamycin (Sigma Aldrich), 35 µg/mL chloramphenicol (Sigma Aldrich), 0.4% (w/v) glucose (Sigma Aldrich) and 0.015% (v/v) Antifoam 204 (Sigma Aldrich); Inducer Pump 1 primed with 0.2% (w/v) arabinose (EMD Biosciences); Incubator Gassing Rate set at 2 sec with 51% oxygen, 0.1 mL inoculation volume; Induction Statistic Mean set w/o Outliers (i.e. block mean OD600 determined after excluding the 3 highest and 3 lowest values); culture vessel blocks (CVB) pre-induction delay set at 1 hr 20 min and Expression Incubator Acclimatization set at 30 min.

The seed cultures were prepared and loaded into Piccolo™ along with the necessary labware: 24-well culture vessel blocks (CVBs; The Automation Partnership), 24-well Filter Plates (The Automation Partnership), 24-well Output Plates (Seahorse Bioscience) and Pipette Tip Boxes (MBP) as specified by the manufacturer. The TB media supplemented as described above, arabinose inducer and associated pumps were prepared under sterile conditions and attached to the machine. The centrifuge counterbalance weight was set and placed inside the centrifuge. Lastly, purification reagents were prepared and attached to the system pumps (lysis buffer, resin, wash buffer and elution buffer as described below). Once this was complete, the machine was started and processing began.

Before inoculation, the inocula were mapped to specific wells of 24-well CVB, and expression and induction conditions were set as described in Table 25 below. Each well of the CVBs were filled with 10 mL of TB media supplemented as described above prior to inoculation from the seed plate. Each well of each CVB was inoculated with 0.1 mL seed culture and then returned to the storage carousel to await scheduled admission to pre-induction incubation. Once a CVB was queued to begin pre-induction incubation it was removed from the storage carousel and coupled to an aeration assembly (which provides agitation, well sealing and a means for controlled administration of oxygen/air) and then placed in the pre-induction incubator. $OD_{600}$ readings were taken upon commencement of incubation and approximately every 30 minutes thereafter. Piccolo operation control software monitors the $OD_{600}$ measurements to predict when each CVB will reach the 1.0 $OD_{600}$ set point. Approximately 30 minutes prior to the CVB reaching the $OD_{600}$ set point the assembly was moved to the expression incubator to equilibrate to the desired expression temperature, and then the cultures in the CVB were induced by addition of the predetermined volume of arabinose as set forth in Table 25. Cell growth was monitored by measuring the $OD_{600}$ every 30 minutes after induction and plotting the data showing total incubation time versus optical density reading. The 6 CVB expressions/purifications schemes from Table 25 were analyzed. CVB01 through CVB04 exhibited the same growth patterns with the $OD_{600}$ maxing out around 20 after approximately 1700 minutes. In these plates, growth of the Fab cultures in each of the individual wells of the plates were similar, with a somewhat greater variability in growth rates per well observed in the CVB03 and CVB04 conditions. CVB05 and CVB06 showed slower growth, with the $OD_{600}$ still increasing at the last time point tested, i.e. total incubation time of 2300 minutes after induction. The growth of the Fab cultures varied between wells of each plate; the maximum $OD_{600}$ between wells varied between $OD_{600}$=10 to $OD_{600}$=16-18.

TABLE 25

Growth Curves of CVB plates Under Various Conditions

| Culture Vessel Block | Inocula Wells of 96-well plate | Post-establishment chill Incubation | Pre-Induction Incubation | Induction Time | Expression Conditions | Induction Conditions |
|---|---|---|---|---|---|---|
| CVB01 | A1, 3, 5, 7, 9, 11<br>B1, 3, 5, 7, 9, 11<br>C1, 3, 5, 7, 9, 11<br>D1, 3, 5, 7, 9, 11 | 41 min 47 s | 7 hr 56 min @ 30° C. | 509 min | 30 hours @ 16° C. | 0.008%(w/v) arabinose at OD = 2 |
| CVB02 | A1, 3, 5, 7, 9, 11<br>B1, 3, 5, 7, 9, 11<br>C1, 3, 5, 7, 9, 11<br>D1, 3, 5, 7, 9, 11 | 4 hr 26 min 25 s | 7 hr 40 min @ 30° C. | 492 min | 36 hours @ 16° C. | 0.008%(w/v) arabinose at OD = 2 |
| CVB03 | E1, 3, 5, 7, 9, 11<br>F1, 3, 5, 7, 9, 11<br>G1, 3, 5, 7, 9, 11<br>H1, 3, 5, 7, 9, 11 | 1 hr 45 min 40 s | 8 hr 11 min @ 30° C. | 525 min | 30 hours @ 16° C. | 0.008%(w/v) arabinose at OD = 2 |
| CVB04 | E1, 3, 5, 7, 9, 11<br>F1, 3, 5, 7, 9, 11<br>G1, 3, 5, 7, 9, 11<br>H1, 3, 5, 7, 9, 11 | 5 hr 31 min 34 s | 8 hr 12 min @ 30° C. | 525 min | 36 hours @ 16° C. | 0.008%(w/v) arabinose at OD = 2 |
| CVB05 | E2, 4, 6, 8, 10, 12<br>F2, 4, 6, 8, 10, 12<br>G2, 4, 6, 8, 10, 12<br>H2, 4, 6, 8, 10, 12 | 3 hr 11 min 23 s | 8 hr 18 min @ 30° C. | 532 min | 30 hours @ 16° C. | 0.008%(w/v) arabinose at OD = 2 |
| CVB06 | E2, 4, 6, 8, 10, 12<br>F2, 4, 6, 8, 10, 12<br>G2, 4, 6, 8, 10, 12<br>H2, 4, 6, 8, 10, 12 | 6 hr 46 min 46 s | 8 hr 35 min @ 30° C. | 549 min | 36 hours @ 16° C. | 0.008%(w/v) arabinose at OD = 2 |

Following culture inoculation and growth induction of cultures, the cells were harvested and lysed for purification of Fabs. Piccolo™ was used for purification of the expressed Fab proteins using an automated expression and purification 'Lifecycle' of a whole culture purification. After controlled expression, CVBs were chilled for 30 minutes at 6° C. in the storage carousel prior to lysis. The CVB was moved to the liquid handling bed and lysis buffer (2.5 mL of Popculture with 1:1000 Lysonase (EMD Biosciences)) was added to each well with thorough mixing. The lysis proceeded for 10 minutes and then the CVB was centrifuged for 10 minutes at 5000×g to pellet cell debris. During centrifugation, a Filter Plate was placed in the filter bed and resin (2 mL of a 50% slurry of Ni-charged His-Bind resin (EMD Biosciences)) was added to each well. Soluble lysate was added to the corresponding wells of the filter plate containing resin and allowed to bind for 10 minutes prior to draining to waste. Wash buffer (12 mL of wash buffer (50 mM Sodium Phosphate, 300 mM NaCl, 30 mM Imidazole, pH 8.0)) was added in two steps to each well and allowed to drain to waste. Finally, an Output Plate was placed under the Filter Plate in the filter bed and IMAC elution buffer ((50 mM Sodium Phosphate, 300 mM NaCl, 500 mM Imidazole)) was added in two steps draining into the output plate. The output plate was returned to the storage carousel as was all other labware. Once this process was complete for each CVB in the designed run, the machine was unloaded.

Using similar Piccolo™ runs with the same clones allowed for the optimization of incubation temperatures for expression, concentration of arabinose inducer and time of expression. Global optimal results were obtained by use of a two-step temperature incubation where the pre-induction samples are incubated at 30° C. Following induction, protein expression was carried out at 20° C. Optimal expression yields were obtained using 0.032% arabinose inducer followed by 45 hours of expression.

Example 10

Orthogonal Secondary Purification of Fab Antibodies

To rapidly further purify partially pure Fabs generated after the Piccolo™ process, an orthogonal method of purification was developed. Fabs were expressed and purified as described above in Example 9 using the Piccolo™ machine. Approximately 1.8 mL of the IMAC elution per Fab sample obtained from Piccolo™ purification was further purified on a 1 mL Hi-Trap Protein G column (GE Healthcare) at 4° C. using the Akta purifier (GE Healthcare) and A-905 autosampler (GE Healthcare) according to the manufacturer's protocol. The protein samples were transferred to a deep well 96-well block (VWR), which was covered by aluminum foil tape to prevent evaporation. The autosampler was set for multiple injections (typically four injections of 450 µL per sample) onto the Hi-Trap Protein G column. The column was then washed with 2 column volumes of 50 mM sodium phosphate pH7.2, 150 mM NaCl. The Fab was eluted with six column volumes of 100 mM glycine pH2.8. The elution peak fractions (approximately 0.8 mL) were collected in a deep well 96-well plate block. The eluted protein was immediately neutralized with 100 µL saturated dibasic sodium phosphate pH9.0. Protein concentration was determined by measuring absorbance at A280 on a Molecular Dynamic plate reader and calculated from the extinction coefficient of the corresponding Fab. Extinction coefficients are calculated based on the total numbers of Tyrosine+Tryptophane+Phenylalanine in the Fab heavy and light chains. Following purification using the Piccolo™ system, expressed protein was generally less than 20% pure. After orthogonal purification with protein G, Fab purity was greater than 95% pure as indicated by SDS-PAGE.

Table 17 sets forth Fab antibodies generated by Piccolo and further purified in a secondary purification. The amino acid sequences of the Fab antibodies correspond to sequences containing variable heavy chain sequences set forth in any of SEQ ID NOS: 1475-1826 and variable light chain sequences set forth in SEQ ID NO: 1827-1838, 1840-1855 and 1857-188. The sequences of the heavy and light chain Fab library members also further contains a sequence for a constant region included in Plasmid A, C or E.

Example 11

Lymphoma Apoptosis Assay

To identify unique Fabs from an antibody library, assays can be performed to assess any desired function, property or activity. As an example of an assay for protein function, cross-linked anti-CD20 Fab (heavy chain set forth in SEQ ID NO:453 and light chain set forth in SEQ ID NO:835) was tested in a cell based assay for the ability to induce apoptosis in lymphoma cells. Anti-CD20 Fabs were cross-linked by adding equal molar concentration of polyclonal anti human kappa light chain antibodies that recognize different parts of the anti-CD20 kappa light chain.

Apoptosis was determined using the Apo-ONE homogenous Caspase-3/7 Assay (Promega). Ramos B-Lymphocyte cells were grown in RPMI1640 media containing 10% FBS (fetal bovine serum), P-S (penicillin-streptomycin) and arrayed into a clear 96-well plate (Costar 3595, Corning, $2.5\times10^4$ cells per well). Jurkat T-Lymphocyte cells were grown in RPMI1640 with 10% FBS and P-S, and arrayed into a clear 96-well plate (Costar 3595, Corning, $2.5\times10^4$ cells per well). Crosslinked anti-CD20 Fab was added to each well at concentrations of 0, 25, 50, 100 and 200 nM together with equal molar concentrations of polyclonal antibody against human kappa light chain (Sigma). Anti-Fas monoclonal antibody (20-100 ng/ml) or staurosporine (1.0 µM) were added for positive controls and trastuzumab Fab was used as a negative control. An equal volume of Apo-ONE Caspase-3/7 Reagent (rhodamine 110, bis-(N-CBZ-L-aspartyl-L-glutamyl-L-valyl-L-aspartic acid amide, Z-DEVD-R110) was added and the plate was incubated for one hour at room temperature. The presence of rhodamine 110 was detected by measuring fluorescence in a fluorescent plate reader at 485 nm exitation/521 nm emission. The increase in the percentage of apoptosis was calculated according to the equation: 100× [(Fluorescence for Fab)−(Fluorescence for background)]/ (Fluorescence for background).

Example 12

Erythropoietin Binding Fab Library

As an alternative to "naïve" libraries, directed Fab libraries are constructed to a known target. In this example, a directed library was constructed in which a 16 amino acid erythropoietin peptide (EPO) was inserted into various CDRs of an antibody to identify Fabs that induce activation of recombinant EPO (EpoR). Because there are variations in the number of amino acid residues that occur in a CDR (see, e.g., Table 26), CDRs with larger inserts were selected for insertion of the EPO peptide. These CDRs include CDR-H2, CDR-H3, CDR-L1, and CDR-L3.

TABLE 26

Amino Acid Length of CDR

|      | Heavy Chain | Light Chain |
|------|-------------|-------------|
| CDR1 | 10-12       | 10-17       |
| CDR2 | 16-19       | 7           |
| CDR3 | 3-25        | 7-11        |

To randomize the orientation of the peptide insert to expose the active surface of the peptide, two extra amino acid residues, either proline or glycine, were added to the N-terminus and C-terminus of the EPO peptide, yielding sixteen different peptides (SEQ ID NO:874-889). A Fab, containing heavy chain VH3-23 (SEQ ID NO:869) and light chain A17 (SEQ ID NO:871), served as a parent antibody for the EPO peptide library. BsaI restriction sites were introduced into the nucleic acid sequences of the EPO peptides and the nucleic acid sequences of the heavy and light chain variable regions in order to allow the cloning of the DNA encoding the EPO peptides into the respective CDRs. Heavy chain VH3-23 DNA was modified to create VH3-23B (SEQ ID NO:896) containing BsaI sites at CDR2 and VH3-23R (SEQ ID NO:913) containing BsaI sites at CDR3. Light chain A17 DNA was modified to create A17P (SEQ ID NO:872) containing BsaI sites at CDR1 and A17Q (SEQ ID NO:873) containing BsaI sites at CDR3. Sixteen different genes encoding the EPO peptides were cloned into the respective heavy (CDR2 and CDR3) or light (CDR1 and CDR3) chain sequences and the resulting Fabs were expressed and purified as described in Example 9. Table 27 lists the resulting 64 EPO containing Fabs.

TABLE 27

EPO Peptide containing Fab Library

| HEAVY CHAIN | | LIGHT CHAIN | |
|---|---|---|---|
| NAME | SEQ ID NO | NAME | SEQ ID NO |
| H2-EP14 (VH3-23B) | 897 | A17 | 871 |
| H2-EP18 (VH3-23B) | 898 | A17 | 871 |
| H2-EP19 (VH3-23B) | 899 | A17 | 871 |
| H2-EP20 (VH3-23B) | 900 | A17 | 871 |
| H2-EP21 (VH3-23B) | 901 | A17 | 871 |
| H2-EP22 (VH3-23B) | 902 | A17 | 871 |
| H2-EP23 (VH3-23B) | 903 | A17 | 871 |
| H2-EP24 (VH3-23B) | 904 | A17 | 871 |
| H2-EP25 (VH3-23B) | 905 | A17 | 871 |
| H2-EP26 (VH3-23B) | 906 | A17 | 871 |
| H2-EP27 (VH3-23B) | 907 | A17 | 871 |
| H2-EP28 (VH3-23B) | 908 | A17 | 871 |
| H2-EP29 (VH3-23B) | 909 | A17 | 871 |
| H2-EP30 (VH3-23B) | 910 | A17 | 871 |
| H2-EP31 (VH3-23B) | 911 | A17 | 871 |
| H2-EP32 (VH3-23B) | 912 | A17 | 871 |
| H3-EP14 (VH3-23R) | 914 | A17 | 871 |
| H3-EP18 (VH3-23R) | 915 | A17 | 871 |
| H3-EP19 (VH3-23R) | 916 | A17 | 871 |
| H3-EP20 (VH3-23R) | 917 | A17 | 871 |
| H3-EP21 (VH3-23R) | 918 | A17 | 871 |
| H3-EP22 (VH3-23R) | 919 | A17 | 871 |
| H3-EP23 (VH3-23R) | 920 | A17 | 871 |
| H3-EP24 (VH3-23R) | 921 | A17 | 871 |
| H3-EP25 (VH3-23R) | 922 | A17 | 871 |
| H3-EP26 (VH3-23R) | 923 | A17 | 871 |
| H3-EP27 (VH3-23R) | 924 | A17 | 871 |
| H3-EP28 (VH3-23R) | 925 | A17 | 871 |
| H3-EP29 (VH3-23R) | 926 | A17 | 871 |
| H3-EP30 (VH3-23R) | 927 | A17 | 871 |
| H3-EP31 (VH3-23R) | 928 | A17 | 871 |
| H3-EP32 (VH3-23R) | 929 | A17 | 871 |
| VH3-23 | 869 | L1-EP14 (A17P) | 930 |
| VH3-23 | 869 | L1-EP18 (A17P) | 931 |
| VH3-23 | 869 | L1-EP19 (A17P) | 932 |
| VH3-23 | 869 | L1-EP20 (A17P) | 933 |
| VH3-23 | 869 | L1-EP21 (A17P) | 934 |
| VH3-23 | 869 | L1-EP22 (A17P) | 935 |
| VH3-23 | 869 | L1-EP23 (A17P) | 936 |
| VH3-23 | 869 | L1-EP24 (A17P) | 937 |
| VH3-23 | 869 | L1-EP25 (A17P) | 938 |
| VH3-23 | 869 | L1-EP26 (A17P) | 939 |
| VH3-23 | 869 | L1-EP27 (A17P) | 940 |
| VH3-23 | 869 | L1-EP28 (A17P) | 941 |
| VH3-23 | 869 | L1-EP29 (A17P) | 942 |
| VH3-23 | 869 | L1-EP30 (A17P) | 943 |
| VH3-23 | 869 | L1-EP31 (A17P) | 944 |
| VH3-23 | 869 | L1-EP32 (A17P) | 945 |
| VH3-23 | 869 | L3-EP14 (A17Q) | 946 |
| VH3-23 | 869 | L3-EP18 (A17Q) | 947 |
| VH3-23 | 869 | L3-EP19 (A17Q) | 948 |
| VH3-23 | 869 | L3-EP20 (A17Q) | 949 |
| VH3-23 | 869 | L3-EP21 (A17Q) | 950 |
| VH3-23 | 869 | L3-EP22 (A17Q) | 951 |
| VH3-23 | 869 | L3-EP23 (A17Q) | 952 |
| VH3-23 | 869 | L3-EP24 (A17Q) | 953 |
| VH3-23 | 869 | L3-EP25 (A17Q) | 954 |
| VH3-23 | 869 | L3-EP26 (A17Q) | 955 |
| VH3-23 | 869 | L3-EP27 (A17Q) | 956 |
| VH3-23 | 869 | L3-EP28 (A17Q) | 957 |
| VH3-23 | 869 | L3-EP29 (A17Q) | 958 |
| VH3-23 | 869 | L3-EP30 (A17Q) | 959 |
| VH3-23 | 869 | L3-EP31 (A17Q) | 960 |
| VH3-23 | 869 | L3-EP32 (A17Q) | 961 |

Screening to identify Fabs that modulated activation of the Epo Receptor (EpoR, SEQ ID NO:962) was performed in BaF3 cells stably transfected with EpoR-encoding cDNA.

a. MTT Cell Proliferation Assay

The tetrazolium ring of MTT (3-[4,5-dimethylthiazol-2-yl]-2,5-diphenyl tetrazolium bromide) is cleaved by mitochondrial dehydrogenase of viable cells to produce purple MTT formazan crystals that are insoluble in aqueous solution but can be solubilized in acidified isopropanol. BaF3/EpoR cells ($5 \times 10^3$-$5 \times 10^5$) were incubated for one or two days in the presence and in the absence of the Epo Fabs. MTT solution (10% of the culture volume) was added to cells and incubated 3-4 hrs at 37° C. in a $CO_2$ incubator. An equal volume of 0.1 N HCl in isopropanol was added. Absorbance was measured at 570 nm and the number of cells was calculated based on the standard curve.

b. Luciferase Reporter Assay

Activation of EpoR leads to activation of STAT5 transcription factor, which in turn induces transcription of genes including c-myc, bcl-2, pim-1 and cyclin-D. Transcription can be detected by linking the promotor of any one of the above genes to a reporter gene, thus creating a reporter plasmid. Two reporter plasmids were created to assess activation of the EpoR. The first reporter plasmid was constructed by placing the mouse cyclin-D promoter (SEQ ID NO:963) at the 5' end of the luciferase gene in the pGL4.70 vector (Promega; SEQ ID NO:1997). Briefly, pGL4.70 was digested with restriction enzymes NheI and HindIII and the cyclin D promoter was inserted between nucleotides 28-66 of the plasmid using standard molecular biology protocols.

An EPO Fab that is capable of activating EpoR will cause activation of STAT5, thereby activating the cyclin-D promoter causing induction and expression of the luciferase gene. Hence, a second reporter plasmid was created for STAT5 by using the pGL4.23 vector (Promega; SEQ ID NO: 1998), a vector that contains a minimal promoter at the 5' end of the translation start site for luciferase that allows for activation of a promoterless-response element to drive expression. Six repeats of a DNA element for STAT5 binding (SEQ ID NO:964) were cloned directly upstream of the minimal promoter. Briefly, pGL4.23 was digested with restriction enzymes NheI and HindIII and the DNA element repeats of STAT5 was inserted between nucleotides 28-66 of the plasmid using standard molecular biology protocols.

An EPO Fab capable of activating EpoR will cause the activation of STAT5 and the direct expression of the luciferase gene. BaF3 cells, previously transfected with EpoR-encoding cDNA, were transiently transfected with one of the reporter plasmids above. The resulting cells are incubated in the presence and absence of EPO Fabs. An equal volume of lysis buffer containing luciferase substrate is added to the cell culture. Relative luminescence was measured for 10 seconds using a luminometer after 5 min incubation with the substrate.

Example 13

Electrochemiluminescence Binding Assay

In this example, an electrochemiluminescence (ECL) binding assay was used to screen a 960 member Fab library for antibodies capable of binding to one of nine different antigens, including the human epidermal growth factor 2 receptor (ErbB2), epidermal growth factor receptor (EGF R), hepatocyte growth factor receptor (HGF R/c-Met), Notch-1, CD44, insulin-like growth factor-1 soluble receptor (IGF-1 sR), P-cadherin, erythropoietin receptor (Epo R) and delta-like protein 4 (DLL4). In an ECL assay, an antigen-antibody interaction is detected by addition of a detection antibody labeled with ruthenium tri-bispyridine-(4-methysulfone) (Ru (bpy)$_2^{2+}$). Upon application of an electric current, the Ru(bpy)$_2^{2+}$-label undergoes an oxidation-reduction cycle in the presence of a co-reactant and light is emitted. A signal is only generated when the Ru(bpy)$_2^{2+}$-label is in close proximity to the electrode, eliminating the need for washing. Detected light intensity is proportional to the amount of captured protein.

Recombinant human proteins were obtained from R&D Systems and included: rHuman ErbB2/Fc Chimera, CF (Cat#1129-ER); rHuman EGF R/Fc Chimera, CF (Cat#344-ER); rHuman HGF R/c-MET/Fc Chimera, CF (Cat#358-MT/CF); rHuman Notch-1/Fc Chimera, CF (Cat#3647-TK); rHuman CD44/Fc Chimera, CF (Cat#3660-CD); rHuman IGF-1 sR,(IGF-1 sR), CF (Cat#391-GR); rHuman P-Cadherin/Fc Chimera, CF (Cat#861-PC); rHuman Erythropoietin R/Fc Chimera, CF (Cat#963-ER); and Recombinant Human DLL4 (Cat#1506-D4/CF). The proteins were immobilized onto each well of 10 plates by spotting 50 nanoliters (nl) of each protein (of a 60 μg/mL antigen) on the surface of a 96-well Multi-Spot 10 Highbind plate (Meso Scale Discovery; Gaithersburg Md.). Spot 10 was left blank as a control.

An 150 μl aliquot of 1% Bovine Serum Albumin (BSA) in Tris-buffered Saline Tween (TBST) was added to each well and allowed to incubate for 30 min at 20° C. followed by washing and tap drying to completely remove any residual solution. Subsequently, a 12.5 μl aliquot of 1% BSA TBST was added to each well followed by the addition of a 12.5 μl aliquot of a purified Fab. The plate was sealed and incubated for 1 hour at 20° C. with shaking.

Detection antibodies were prepared by individually conjugating both goat anti-human Kappa light chain polyclonal antibody (K3502-1MG, Sigma-Aldrich) and goat anti-human Lambda light chain polyclonal antibody (L1645-1ML, Sigma-Aldrich) with Ruthenium (II) tris-bipyridine-(4-methylsulfone)-N-hydroxysuccinimide (SULFO-TAG NHS-ester, Meso Scale Discovery) according to the manufacturer's instructions. TAG-detection antibody at 25 μl was added to each well and allowed to incubate for 1 hour at 20° C. with shaking. Finally, 15 μl of Read Buffer P with Surfactant (Cat #R92PC-1, Meso Scale Discovery) was added to each well. The electrochemiluminescence was measured using a Sector Imager 2400 (Meso Scale Discovery). Data was analyzed by comparing the ECL signals for an antigen to the blank of each well. A signal to blank ratio of 4 or more was considered a "Hit" Fab.

Ten plates, each containing 96 different Fabs, were screened using the ECL assay. The results of the initial screen are shown in Tables 28-28B, below. Table 28, below, lists the 6 Fabs (including the heavy chain and light chain) that were identified as "hits" in the initial ECL screen. A "hit" was a Fab antibody with signal to blank ratio of greater than 4. Three Fabs were identified that bind to recombinant human delta-like protein 4 (DLL4). One Fab was identified that binds to recombinant human epidermal growth factor 2 (ErbB2) and one Fab was identified that binds to recombinant human erythropoietin receptor (Epo R). An additional Fab was identified that binds to both ErbB2 and EpoR. The results of the initial MSD assay screen at a single Fab concentration are listed in Table 28B below. Table 28B lists the 6 Fabs (the Fab No. corresponds each of the Fabs identified in Table 28), the Fab concentration, the 9 recombinant human target/protein antigens, and the ECL signals from the initial MSD assay screen at the given Fab concentration.

To confirm a "Hit" from the intial ECL screening, a Fab concentration dependent titration was carried out to determine the Fab-antigen binding affinity. The assay procedure was the same as described above, except that the concentration of Fab antibody was varied between wells from 0.1 nM to 2.4 μM. The data are set forth in Tables 29-34 below. The data were graphed using Microsoft Excel and the binding affinity was estimated from the 50% binding signal. As noted, binding affinity can be assay dependent (see Example 16).

The results show that Fab VH1-46_IGHD6-6*01_IGHJ1*01 & L6_IGKJ1*01 specifically binds Human DLL4 with high affinity in the lower nanomolar range at or about 10 nM or lower, whereas Fabs VH5-51_IGHD5-18*01>3-IGHJ4*01 & V3-4_IGLJ1*01, and VH6-1-IGHD3-3*01-IGHJ4*01 & V4-3-IGLJ4*01 bind Human DLL4 in the micromolar range. Since the three Fabs contain different heavy and light chains, the results suggest that the binding epitopes on DL44 recognized by the antibodies can be different.

The results further show that Fab VH4-31IGHD1-26*01_IGHJ2*01 & A27_IGKJ1*01 binds Human ErbB2/Fc chimera at a concentration of approximately 100 nM and Fab VH1-46_IGHD3-10*01_IGHJ4*01 & B3_IGKJ1*01 binds Human Erythropoietin R/Fc chimera at a concentration of approximately 100 nM. One Fab, VH1-46_IGHD6-13*01_IGH41*01 & B3_IGKJ1*01, shows affinity for both Human ErbB2/Fc and Human Erythropoietin R/Fc chimeras. It is unlikely that this Fab is binding to the Fc region of the chimera proteins, since no binding was observed to five other antigens that were Fc fusion proteins.

TABLE 28

Identified Fab "Hits"

| Fab No. | Target | Heavy Chain | SEQ ID NO | Light Chain | SEQ ID NO |
|---|---|---|---|---|---|
| 1 | rHuman DLL4 | VH1-46__IGHD6-6*01__IGHJ1*01 | 1513 | L6__IGKJ1*01 | 1850 |
| 2 | rHuman DLL4 | VH5-51__IGHD5-18*01>3__IGHJ4*01 | 1803 | V3-4__IGLJ1*01 | 1881 |
| 3 | rHuman DLL4 | VH6-1__IGHD3-3*01__IGHJ4*01 | 1812 | V4-3__IGLJ4*01 | 1884 |
| 4 | rHuman ErbB2/Fc chimera | VH4-31__IGHD1-26*01__IGHJ2*01 | 1760 | A27__IGKJ1*01 | 1833 |
| 5 | rHuman Epo R/Fc chimera | VH1-46__IGHD3-10*01__IGHJ4*01 | 1509 | B3__IGKJ1*01 | 1838 |
| 6 | rHuman ErbB2/Fc chimera and rHuman Epo R/Fc chimera | VH1-46__IGHD6-13*01__IGHJ4*01 | 1512 | B3__IGKJ1*01 | 1838 |

TABLE 28B

ECL Signals for Identified Fab "Hits" from 960 Fab Library Screen

| Fab No. | [Fab] uM | ErbB2 | EGFR | HGFR | Notch-1 | CD44 | IGF-1 | P-cad | EPOR | DLL4 | Blank |
|---|---|---|---|---|---|---|---|---|---|---|---|
| 1 | 0.14 | 870 | 823 | 848 | 614 | 515 | 663 | 423 | 693 | 19293 | 237 |
| 2 | 2.38 | 594 | 681 | 931 | 636 | 666 | 691 | 1224 | 834 | 12172 | 526 |
| 3 | 0.21 | 9229 | 815 | 744 | 949 | 837 | 763 | 890 | 1115 | 1069 | 529 |
| 4 | 0.23 | 1251 | 942 | 954 | 722 | 675 | 982 | 508 | 777 | 2808 | 363 |
| 5 | 0.74 | 562 | 652 | 633 | 980 | 682 | 593 | 1155 | 4108 | 1000 | 692 |
| 6 | 0.43 | 16499 | 1233 | 1138 | 1793 | 1497 | 1139 | 5245 | 12985 | 2538 | 879 |

TABLE 29

Binding affinity of Fab VH1-46__IGHD6-6*01__IGHJ1*01 & L6__IGKJ1*01

| Fab[nM] | 2383 | 595.8 | 148.9 | 37.2 | 9.3 | 2.3 | 0.6 | 0.1 |
|---|---|---|---|---|---|---|---|---|
| ErbB2/Fc | 454 | 321 | 247 | 384 | 354 | 291 | 215 | 306 |
| EGF R/Fc | 621 | 403 | 290 | 228 | 424 | 289 | 309 | 311 |
| HGF R/Fc | 762 | 353 | 205 | 207 | 324 | 253 | 256 | 286 |
| Notch-1/Fc | 690 | 306 | 375 | 402 | 492 | 333 | 337 | 378 |
| CD44/FC | 559 | 372 | 348 | 356 | 396 | 317 | 238 | 323 |
| IGF-1 sR | 527 | 335 | 322 | 295 | 315 | 231 | 313 | 241 |
| P-Cadherin/Fc | 728 | 617 | 687 | 649 | 452 | 401 | 321 | 235 |
| EPO R/Fc | 658 | 378 | 373 | 315 | 306 | 429 | 337 | 373 |
| DLL4 | 11794 | 17203 | 16253 | 16717 | 13210 | 3055 | 508 | 317 |
| Blank | 344 | 285 | 218 | 199 | 287 | 234 | 226 | 201 |

TABLE 30

Binding affinity of Fab VH5-51__IGHD5-18*01>3__IGHJ4*01 & V3-4__IGLJ1*01

| Fab[nM] | 154 | 51 | 17 | 6 |
|---|---|---|---|---|
| ErbB2/Fc | 1593 | 1248 | 1033 | 873 |
| EGF R/Fc | 1398 | 816 | 805 | 742 |
| HGF R/Fc | 1520 | 1044 | 914 | 831 |
| Notch-1/Fc | 929 | 685 | 558 | 464 |
| CD44/Fc | 960 | 651 | 518 | 547 |
| IGF-1 sR | 1396 | 1051 | 872 | 854 |
| P-Cadherin/Fc | 1733 | 854 | 542 | 358 |
| EPO R/Fc | 1195 | 750 | 620 | 548 |
| DLL4 | 40392 | 17025 | 7158 | 1946 |
| Blank | 447 | 335 | 143 | 191 |

TABLE 31

Binding affinity of Fab VH6-1__IGHD3-3*01__IGHJ4*01 & V4-3__IGLJ4*01

| Fab[nM] | 480 | 240 | 120 | 60 | 30 | 15 | 7.5 | 3.8 |
|---|---|---|---|---|---|---|---|---|
| ErbB2/Fc | 965 | 833 | 822 | 777 | 726 | 713 | 695 | 714 |
| EGF R/Fc | 877 | 690 | 658 | 679 | 585 | 584 | 582 | 511 |
| HGF R/Fc | 951 | 834 | 785 | 623 | 640 | 694 | 558 | 519 |
| Notch-1/Fc | 545 | 368 | 472 | 415 | 425 | 508 | 392 | 383 |
| CD44/FC | 541 | 470 | 442 | 434 | 484 | 454 | 444 | 419 |
| IGF-1 sR | 741 | 625 | 813 | 654 | 697 | 705 | 642 | 463 |
| P-Cadherin/Fc | 596 | 383 | 450 | 372 | 440 | 351 | 352 | 281 |
| EPO R/Fc | 621 | 478 | 431 | 423 | 325 | 397 | 443 | 407 |
| DLL4 | 1532 | 1273 | 938 | 875 | 736 | 690 | 598 | 462 |
| Blank | 362 | 316 | 363 | 237 | 213 | 261 | 217 | 198 |

TABLE 32

Binding affinity of Fab VH4-31_IGHD1-26*01_IGHJ2*01 & A27_IGKJ1*01

| Fab[nM] | 410 | 205 | 102.5 | 51.3 | 25.6 | 12.8 | 6.4 | 3.2 |
|---|---|---|---|---|---|---|---|---|
| ErbB2/Fc | 5422 | 5260 | 4355 | 3588 | 2992 | 2255 | 1796 | 868 |
| EGF R/Fc | 734 | 595 | 455 | 379 | 373 | 320 | 249 | 254 |
| HGF R/Fc | 753 | 735 | 425 | 456 | 382 | 258 | 234 | 294 |
| Notch-1/Fc | 804 | 722 | 607 | 408 | 270 | 249 | 279 | 275 |
| CD44/FC | 767 | 613 | 461 | 409 | 332 | 273 | 240 | 295 |
| IGF-1 sR | 600 | 565 | 443 | 316 | 311 | 323 | 209 | 313 |
| P-Cadherin/Fc | 814 | 769 | 714 | 424 | 323 | 245 | 197 | 206 |
| EPO R/Fc | 797 | 595 | 587 | 498 | 409 | 338 | 264 | 233 |
| DLL4 | 859 | 599 | 550 | 474 | 384 | 268 | 256 | 242 |
| Blank | 637 | 430 | 437 | 337 | 345 | 227 | 133 | 172 |

TABLE 33

Binding affinity of Fab VH1-46_IGHD3-10*01_IGHJ4*01 & B3_IGKJ1*01

| Fab[nM] | 1410 | 705 | 352.5 | 176.3 | 88.1 | 44.1 | 22 | 11 |
|---|---|---|---|---|---|---|---|---|
| ErbB2/Fc | 932 | 671 | 514 | 448 | 200 | 347 | 363 | 216 |
| EGF R/Fc | 1071 | 692 | 769 | 428 | 376 | 428 | 312 | 201 |
| HGF R/Fc | 903 | 839 | 606 | 418 | 392 | 336 | 203 | 268 |
| Notch-1/Fc | 1034 | 958 | 715 | 664 | 440 | 331 | 389 | 404 |
| CD44/FC | 885 | 693 | 556 | 376 | 340 | 302 | 317 | 296 |
| IGF-1 sR | 426 | 630 | 528 | 393 | 273 | 309 | 347 | 289 |
| P-Cadherin/Fc | 1059 | 827 | 649 | 532 | 278 | 343 | 215 | 270 |
| EPO R/Fc | 4314 | 4894 | 4105 | 3519 | 3368 | 2387 | 2241 | 1824 |
| DLL4 | 1265 | 981 | 660 | 460 | 434 | 388 | 342 | 254 |
| Blank | 709 | 483 | 494 | 346 | 301 | 200 | 289 | 212 |

TABLE 34

Binding affinity of Fab VH1-46_IGHD6-13*01_IGHJ4*01 & B3_IGKJ1*01

| Fab[nM] | 1000 | 500 | 250 | 125 | 62.5 | 31.3 | 15.6 | 7.8 |
|---|---|---|---|---|---|---|---|---|
| ErbB2/Fc | 8731 | 10241 | 11026 | 12956 | 13124 | 13911 | 14791 | 13220 |
| EGF R/Fc | 2236 | 1468 | 1138 | 860 | 602 | 447 | 346 | 379 |
| HGF R/Fc | 2109 | 1371 | 1221 | 778 | 578 | 299 | 293 | 282 |
| Notch-1/Fc | 2267 | 1975 | 1241 | 802 | 536 | 563 | 418 | 486 |
| CD44/FC | 1966 | 1685 | 1175 | 764 | 591 | 439 | 473 | 409 |
| IGF-1 sR | 1667 | 1334 | 993 | 654 | 491 | 385 | 349 | 353 |
| P-Cadherin/Fc | 4495 | 3447 | 2784 | 1481 | 1173 | 1105 | 971 | 695 |
| EPO R/Fc | 8594 | 10305 | 8535 | 9237 | 7749 | 7878 | 8357 | 6765 |
| DLL4 | 2785 | 2319 | 1560 | 912 | 715 | 528 | 525 | 407 |
| Blank | 1133 | 680 | 590 | 403 | 268 | 250 | 294 | 316 |

Example 14

VH3-23 Heavy Chain Library

In this example, a library of 690 different VH3-23 containing heavy chains was generated using standard molecular biology protocols. Library diversity was generated by 1) use of 6 different $J_H$ segments; 2) including the DIRECT sequence and INVERTED sequence (or reverse complement) of each $D_H$ segment; and 3) translating each DIRECT and INVERTED $D_H$ segment in all 3 reading frames. This resulted in the initial generation of six pF-VH3-23-IGHJ plasmids and 115 different $D_H$ segments. Simultaneous cloning of each individual $D_H$ segment into each pF-VH3-23-IGHJ plasmid resulted in the 690 member heavy chain library. The library was then transformed with various previously generated light chains (see Example 8) to generate a 3012 member Fab library.

A. Generation of pF-VH3-23-IGHJ1 to pF-VH3-23-IGHJ6 Plasmids

In this example, 6 plasmids, each encoding the VH3-23 VH segment and one of six $J_H$ segments, were generated. The plasmids were modified such that BsaI sites were incorporated to 1) allow the cloning of individual $J_H$ segments (see Table 35); and 2) subsequently allow the cloning of any individual $D_H$ segment (see Table 37). To this end, Plasmid A (SEQ ID NO:1) and VH segment VH3-23R (SEQ ID NO:2050) were first modified to remove internal BsaI sites (SEQ ID NO:3719). Subsequently, VH3-23R was further modified to add two BsaI sites, including 1) at the 3' end of the VH3-23 VH segment; and 2) at the 5' end of the nucleotides encoding framework region 4 (amino acids WGQGTLVTVSSAS of SEQ ID NOS:3456-3461, see Table 35 below) of the $J_H$ segment. VH3-23R (SEQ ID NO:2050) was then synthesized using standard DNA synthesis protocols. VH3-23R was digested with NcoI (SEQ ID NO:977) and NheI (SEQ ID NO:978) and ligated into the modified Plasmid A creating plasmid pF-VH3-23R (SEQ ID NO:2051).

A series of forward and reverse oligos (see Table 36, below) encoding segments IGHJ1-IGHJ6 (see Table 35, and SEQ ID NOS:3450-3455 and SEQ ID NOS:3456-3461) were generated by standard DNA synthesis protocols. Pairs of oligos (encoding a particular IGHJ segment) were digested with BsaI and ligated into similarly digested plasmid pF-VH3-23R (SEQ ID NO:2051), thereby generating 6 new plasmids: pF-VH3-23-IGHJ1 (SEQ ID NO:2064), pF-VH3-23-IGHJ2 (SEQ ID NO:2065), pF-VH3-23-IGHJ3 (SEQ ID NO:2066), pF-VH3-23-IGHJ4 (SEQ ID NO:2067), pF-VH3-23-IGHJ5 (SEQ ID NO:2068), and pF-VH3-23-IGHJ6 (SEQ ID NO:2069). For each of the new plasmids, this resulted in the removal of the BsaI site at the 5' end of the nucleotides encoding framework region 4 and the generation of a new BsaI site at the 5' end of the $J_H$ segment to allow subsequent cloning of a single $D_H$ segment into all six vectors simultaneously thereby creating six different genes per each $D_H$ segment.

TABLE 35

| IGHJ1 to IGHJ6 Segments | |
|---|---|
| Segment | Nucleotide Sequence |
| IGHJ1 (SEQ ID NO: 3450) | GCT GAA TAC TTC CAG CAC TGG GGC CAA GGA ACC CTG GTC ACC GTC TCC TCA G |
| IGHJ2 (SEQ ID NO: 3451) | C TAC TGG TAC TTC GAT TCC TGG GGC CAA GGA ACC CTG GTC ACC GTC TCC TCA G |
| IGHJ3 (SEQ ID NO: 3452) | T GCT TTT GAT GTC TGG GGC CAA GGA ACC CTG GTC ACC GTC TCC TCA G |
| IGHJ4 (SEQ ID NO: 3453) | AC TAC TTT GAC TAC TGG GGC CAA GGA ACC CTG GTC ACC GTC TCC TCA G |
| IGHJ5 (SEQ ID NO: 3454) | AC AAC TGG TTC GAC TAC TGG GGC CAA GGA ACC CTG GTC ACC GTC TCC TCA G |
| IGHJ6 (SEQ ID NO: 3455) | AT TAC TAC TAC TAC TAC GGT ATG GAC GTC TGG GGC CAA GGA ACC CTG GTC ACC GTC TCC TCA G |
| IGHJ1 (SEQ ID NO: 3456) | AEYFQHWGQGTLVTVSSAS |
| IGHJ2 (SEQ ID NO: 3457) | YWYFDSWGQGTLVTVSSAS |
| IGHJ3 (SEQ ID NO: 3458) | AFDVWGQGTLVTVSSAS |
| IGHJ4 (SEQ ID NO: 3459) | YFDYWGQGTLVTVSSAS |
| IGHJ5 (SEQ ID NO: 3460) | NWFDYWGQGTLVTVSSAS |
| IGHJ6 (SEQ ID NO: 3461) | YYYYYGMDVWGQGTLVTVSSAS |

TABLE 36

| Oligos used to generate J1 to J6 plasmids | |
|---|---|
| Oligo | Nucleotide Sequence |
| J1_F (SEQ ID NO: 2052) | CGAAAGAGACCTACTATGGTTCGGGTCTCTCCTACGCTGAATACTTCCAGCACT |
| J1_R (SEQ ID NO: 2053) | CCCCAGTGCTGGAAGTATTCAGCGTAGGAGAGACCCGAACCATAGTAGGTCTCT |
| J2_F (SEQ ID NO: 2054) | CGAAAGAGACCTACTATGGTTCGGGTCTCTCCTACTACTGGTACTTCGATTCCT |
| J2_R (SEQ ID NO: 2055) | CCCCAGGAATCGAAGTACCAGTAGTAGGAGAGACCCGAACCATAGTAGGTCTCT |
| J3_F (SEQ ID NO: 2056) | CGAAAGAGACCTACTATGGTTCGGGTCTCTCCTATGCTTTTGATGTCT |
| J3_R (SEQ ID NO: 2057) | CCCCAGACATCAAAAGCATAGGAGAGACCCGAACCATAGTAGGTCTCT |
| J4_F (SEQ ID NO: 2058) | CGAAAGAGACCTACTATGGTTCGGGTCTCTCCTACTACTTTGACTACT |
| J4_R (SEQ ID NO: 2059) | CCCCAGTAGTCAAAGTAGTAGGAGAGACCCGAACCATAGTAGGTCTCT |
| J5_F (SEQ ID NO: 2060) | CGAAAGAGACCTACTATGGTTCGGGTCTCTCCTACAACTGGTTCGACTACT |
| J5_R (SEQ ID NO: 2061) | CCCCAGGAGTCGAACCAGTTGTAGGAGAGACCCGAACCATAGTAGGTCTCT |

TABLE 36-continued

Oligos used to generate J1 to J6 plasmids

| Oligo | Nucleotide Sequence |
|---|---|
| J6_F (SEQ ID NO: 2062) | CGAAAGAGACCTACTATGGTTCGGGTCTCTCCTATTACTACTACTACTACGGTATGGACGTCT |
| J6_R (SEQ ID NO: 2063) | CCCCAGACGTCCATACCGTAGTAGTAGTAGTAATAGGAGAGACCCGAACCATAGTAGGTCTCT |

B. Generation and Cloning of Modified $D_H$ Oligos into pF-VH3-23-IGHJ Plasmids

In this example, pairs of $D_H$ oligos were generated and cloned into the pF-VH3-23-IGHJ plasmids thereby generating 690 new VH3-23 heavy chains as follows. Twenty seven (27) $D_H$ segments (see Table 37 below) were selected for cloning into each modified pF-VH3-23-IGHJ plasmid. Library diversity in the CDR3 region was generated by 1) including the DIRECT sequence and INVERTED sequence (or reverse complement) of each $D_H$ segment; and 2) translating each DIRECT and INVERTED $D_H$ segment in all 3 reading frames. If the translation of a reading frame for any given $D_H$ segment resulted in a stop codon, that particular sequence and reading frame were excluded from the library. Table 37 below indicates the open reading frames for each particular $D_H$ segment that were included in the library, thereby resulting in 115 different $D_H$ segments.

TABLE 37

$D_H$ segments included in heavy chain library

| | | DIRECT | | INVERTED | |
|---|---|---|---|---|---|
| Number | D segment | (SEQ ID NO) | Reading Frames | (SEQ ID NO) | Reading Frames |
| 1 | IGHD1-1*01 | 239 | 1, 2, 3 | 3462 | 1, 2, 3 |
| 2 | IGHD1-7*01 | 243 | 1, 3 | 3463 | 1, 3 |
| 3 | IGHD1-14*01 | 240 | 1, 3 | 3464 | 1, 2, 3 |
| 4 | IGHD1-20*01 | 241 | 1, 3 | 3465 | 1, 2, 3 |
| 5 | IGHD1-26*01 | 242 | 1, 3 | 3466 | 1, 3 |
| 6 | IGHD2-2*01 | 245 | 2, 3 | 3467 | 1, 3 |
| 7 | IGHD2-8*01 | 250 | 2, 3 | 3468 | 1 |
| 8 | IGHD2-15*01 | 244 | 2, 3 | 3469 | 1, 3 |
| 9 | IGHD2-21*01 | 248 | 2, 3 | 3470 | 1, 3 |
| 10 | IGHD3-3*01 | 258 | 1, 2, 3 | 3471 | 1, 3 |
| 11 | IGHD3-9*01 | 259 | 2 | 3472 | 1, 3 |
| 12 | IGHD3-10*01 | 252 | 2, 3 | 3473 | 1, 3 |
| 13 | IGHD3-16*01 | 254 | 2, 3 | 3474 | 1, 3 |
| 14 | IGHD3-22*01 | 256 | 2, 3 | 3475 | 1, 3 |
| 15 | IGHD4-4*01 | 263 | 2, 3 | 3476 | 1, 3 |
| 16 | IGHD4-11*01 | 260 | 2, 3 | 3477 | 1, 3 |
| 17 | IGHD4-17*01 | 261 | 2, 3 | 3478 | 1, 3 |
| 18 | IGHD4-23*01 | 262 | 2, 3 | 3479 | 1, 3 |
| 19 | IGHD5-5*01 | 267 | 1, 2, 3 | 3480 | 1, 3 |
| 20 | IGHD5-12*01 | 264 | 1, 3 | 3481 | 1, 3 |
| 21 | IGHD5-18*01 | 265 | 1, 2, 3 | 3482 | 1, 3 |
| 22 | IGHD5-24*01 | 266 | 1, 3 | 3483 | 1, 3 |
| 23 | IGHD6-6*01 | 271 | 1, 2 | 3484 | 1, 2, 3 |
| 24 | IGHD6-13*01 | 268 | 1, 2 | 3485 | 1, 2, 3 |
| 25 | IGHD6-19*01 | 269 | 1, 2 | 3486 | 1, 2, 3 |
| 26 | IGHD6-25*01 | 270 | 1, 2 | 3487 | 1, 3 |
| 27 | IGHD7-27*01 | 272 | 1, 3 | 3488 | 1, 2 |

The following rules (see Table 38) were used to design pairs of D oligos for cloning into the six different vectors to ensure that the resulting heavy chain sequences are in frame. The rules were applied to both the direct and inverted $D_H$ segments. In order to facilite cloning into the BsaI sites of the pF-VH3-23-IGHJ plasmids, the following nucleotides were added to the $D_H$ segment oligonucleotides:

DIRECT 5' End: CGAAA;

DIRECT 3' End: T;

INDIRECT 5' End: CGAAA;

INDIRECT 3' End: T.

The resulting oligos for each particular $D_H$ segment are listed in Tables 39-40 below. The nucleotides added to facilite cloning are in lower case letters. The nucleotides encoding the $D_H$ segment are in upper case letters. The oligos were synthesized by standard DNA synthesis technology. Pairs of oligos (encoding a particular $D_H$ segment) were digested with BsaI and ligated into similarly digested plasmids pF-VH3-23-IGHJ1 to pF-VH3-23-IGHJ6 thereby generating a VH3-23 library of 690 members, listed in Table 41 below. The VH3-23 heavy chain library was co-transformed with various light chains (as described in Example 8) creating a Fab library of 3012 members.

TABLE 38

Rules for generation of $D_H$ segment oligos

| Frame | No. of nucleotides | Manipulation |
|---|---|---|
| 1 | 3N | NONE |
| 1 | 3N + 1 | Remove nucleotide at 3' end |
| 1 | 3N + 2 | Add G to 3' end |
| 2 | 3N | Remove nucleotide at 5' end, add G to 3' end |
| 2 | 3N + 1 | Remove nucleotide at 5' end |
| 2 | 3N + 2 | Remove nucleotide at 5' end, add GG to 3' end |
| 3 | 3N | Add G to 5' end, remove nucleotide at 3' end |
| 3 | 3N + 1 | Add G to 5' end, remove 2 nucleotides at 3' end |
| 3 | 3N + 2 | Add G to 5' end |

TABLE 39

Direct D$_H$ segment oligos

| D segment | Forward | SEQ ID NO | Reverse | SEQ ID NO |
|---|---|---|---|---|
| 1_IGHD1-1*01 | cgaaaGGTACAACTGGAACGACGt | 3489 | taggaCGTCGTTCCAGTTGTACCt | 3490 |
| 2_IGHD1-1*01 | cgaaaGTACAACTGGAACGACGGt | 3491 | taggaCCGTCGTTCCAGTTGTACt | 3492 |
| 3_IGHD1-1*01 | cgaaaGGGTACAACTGGAACGACt | 3493 | taggaGTCGTTCCAGTTGTACCCt | 3494 |
| 1_IGHD1-7*01 | cgaaaGGTATAACTGGAACTACGt | 3495 | taggaCGTAGTTCCAGTTATACCt | 3496 |
| 3_IGHD1-7*01 | cgaaaGGGTATAACTGGAACTACt | 3497 | taggaGTAGTTCCAGTTATACCCt | 3498 |
| 1_IGHD1-14*01 | cgaaaGGTATAACCGGAACCACGt | 3499 | taggaCGTGGTTCCGGTTATACCt | 3500 |
| 3_IGHD1-14*01 | cgaaaGGGTATAACCGGAACCACt | 3501 | taggaGTGGTTCCGGTTATACCCt | 3502 |
| 1_IGHD1-20*01 | cgaaaGGTATAACTGGAACGACGt | 3503 | taggaCGTCGTTCCAGTTATACCt | 3504 |
| 3_IGHD1-20*01 | cgaaaGGGTATAACTGGAACGACt | 3505 | taggaGTCGTTCCAGTTATACCCt | 3506 |
| 1_IGHD1-26*01 | cgaaaGGTATAGTGGGAGCTACTACGt | 3507 | taggaCGTAGTAGCTCCCACTATACCt | 3508 |
| 3_IGHD1-26*01 | cgaaaGGGTATAGTGGGAGCTACTACt | 3509 | taggaGTAGTAGCTCCCACTATACCCt | 3510 |
| 2_IGHD2-2*01 | cgaaaGGATATTGTAGTAGTACCAGCTGCTATGCCt | 3511 | taggaGGCATAGCAGCTGGTACTACTACAATATCCt | 3512 |
| 3_IGHD2-2*01 | cgaaaGAGGATATTGTAGTAGTACCAGCTGCTATGt | 3513 | taggaCATAGCAGCTGGTACTACTACAATATCCTCt | 3514 |
| 2_IGHD2-8*01 | cgaaaGGATATTGTACTAATGGTGTATGCTATACCt | 3515 | taggaGGTATAGCATACACCATTAGTACAATATCCt | 3516 |
| 3_IGHD2-8*01 | cgaaaGAGGATATTGTACTAATGGTGTATGCTATAt | 3517 | taggaTATAGCATACACCATTAGTACAATATCCTCt | 3518 |
| 2_IGHD2-15*01 | cgaaaGGATATTGTAGTGGTGGTAGCTGCTACTCCt | 3519 | taggaGGAGTAGCAGCTACCACCACTACAATATCCt | 3520 |
| 3_IGHD2-15*01 | cgaaaGAGGATATTGTAGTGGTGGTAGCTGCTACTt | 3521 | taggaAGTAGCAGCTACCACCACTACAATATCCTCt | 3522 |
| 2_IGHD2-21*01 | cgaaaGCATATTGTGGTGGTGATTGCTATTCCt | 3523 | taggaGGAATAGCAATCACCACCACAATATGCt | 3524 |
| 3_IGHD2-21*01 | cgaaaGAGCATATTGTGGTGGTGATTGCTATTt | 3525 | taggaAATAGCAATCACCACCACAATATGCTCt | 3526 |
| 1_IGHD3-3*01 | cgaaaGTATTACGATTTTTGGAGTGGTTATTATACt | 3527 | taggaGTATAATAACCACTCCAAAAATCGTAATACt | 3528 |
| 2_IGHD3-3*01 | cgaaaTATTACGATTTTTGGAGTGGTTATTATACCt | 3529 | taggaGGTATAATAACCACTCCAAAAATCGTAATAt | 3530 |
| 3_IGHD3-3*01 | cgaaaGGTATTACGATTTTTGGAGTGGTTATTATAt | 3531 | taggaTATAATAACCACTCCAAAAATCGTAATACCt | 3532 |
| 2_IGHD3-9*01 | cgaaaTATTACGATATTTTGACTGGTTATTATAACt | 3533 | taggaGTTATAATAACCAGTCAAAATATCGTAATAt | 3534 |
| 2_IGHD3-10*01 | cgaaaTATTACTATGGTTCGGGAGTTATTATAACt | 3535 | taggaGTTATAATAACTCCCCGAACCATAGTAATAt | 3536 |
| 3_IGHD3-10*01 | cgaaaGGTATTACTATGGTTCGGGGAGTTATTATAt | 3537 | taggaTATAATAACTCCCCGAACCATAGTAATACCt | 3538 |
| 2_IGHD3-16*01 | cgaaaTATTATGATTACGTTTGGGGAGTTATGCTTATACCt | 3539 | taggaGGTATAAGCATAACTCCCCCAAACGTAATCATAATAt | 3540 |
| 3_IGHD3-16*01 | cgaaaGGTATTATGATTACGTTTGGGGGAGTTATGCTTATAt | 3541 | taggaTATAAGCATAACTCCCCCAAACGTAATCATAATACCt | 3542 |
| 2_IGHD3-22*01 | cgaaaTATTACTATGATAGTAGTGGTTATTACTACt | 3543 | taggaGTAGTAATAACCACTACTATCATAGTAATAt | 3544 |

TABLE 39-continued

Direct D_H segment oligos

| D segment | Forward | SEQ ID NO | Reverse | SEQ ID NO |
|---|---|---|---|---|
| 3_IGHD3-22*01 | cgaaaGGTATTACTATGATAGTAGTGGTTATTACTt | 3545 | taggaAGTAATAACCACTACTATCATAGTAATACCt | 3546 |
| 2_IGHD4-4*01 (1) | cgaaaGACTACAGTAACTACt | 3547 | taggaGTAGTTACTGTAGTCt | 3548 |
| 3_IGHD4-4*01 (1) | cgaaaGTGACTACAGTAACTt | 3549 | taggaAGTTACTGTAGTCACt | 3550 |
| 2_IGHD4-11*01 (1) | cgaaaGACTACAGTAACTACt | 3551 | taggaGTAGTTACTGTAGTCt | 3552 |
| 3_IGHD4-11*01 (1) | cgaaaGTGACTACAGTAACTt | 3553 | taggaAGTTACTGTAGTCACt | 3554 |
| 2_IGHD4-17*01 | cgaaaGACTACGGTGACTACt | 3555 | taggaGTAGTCACCGTAGTCt | 3556 |
| 3_IGHD4-17*01 | cgaaaGTGACTACGGTGACTt | 3557 | taggaAGTCACCGTAGTCACt | 3558 |
| 2_IGHD4-23*01 | cgaaaGACTACGGTGGTAACTCCt | 3559 | taggaGGAGTTACCACCGTAGTCt | 3560 |
| 3_IGHD4-23*01 | cgaaaGTGACTACGGTGGTAACTt | 3561 | taggaAGTTACCACCGTAGTCACt | 3562 |
| 1_IGHD5-5*01 (2) | cgaaaGTGGATACAGCTATGGTTACGt | 3563 | taggaCGTAACCATAGCTGTATCCACt | 3564 |
| 2_IGHD5-5*01 (2) | cgaaaTGGATACAGCTATGGTTACGGt | 3565 | taggaCCGTAACCATAGCTGTATCCAt | 3566 |
| 3_IGHD5-5*01 (2) | cgaaaGGTGGATACAGCTATGGTTACt | 3567 | taggaGTAACCATAGCTGTATCCACCt | 3568 |
| 1_IGHD5-12*01 | cgaaaGTGGATATAGTGGCTACGATTACGt | 3569 | taggaCGTAATCGTAGCCACTATATCCACt | 3570 |
| 3_IGHD5-12*01 | cgaaaGGTGGATATAGTGGCTACGATTACt | 3571 | taggaGTAATCGTAGCCACTATATCCACCt | 3572 |
| 1_IGHD5-18*01 (2) | cgaaaGTGGATACAGCTATGGTTACGt | 3573 | taggaCGTAACCATAGCTGTATCCACt | 3574 |
| 2_IGHD5-18*01 (2) | cgaaaTGGATACAGCTATGGTTACGGt | 3575 | taggaCCGTAACCATAGCTGTATCCAt | 3576 |
| 3_IGHD5-18*01 (2) | cgaaaGGTGGATACAGCTATGGTTACt | 3577 | taggaGTAACCATAGCTGTATCCACCt | 3578 |
| 1_IGHD5-24*01 | cgaaaGTAGAGATGGCTACAATTACGt | 3579 | taggaCGTAATTGTAGCCATCTCTACt | 3580 |
| 3_IGHD5-24*01 | cgaaaGGTAGAGATGGCTACAATTACt | 3581 | taggaGTAATTGTAGCCATCTCTACCt | 3582 |
| 1_IGHD6-6*01 | cgaaaGAGTATAGCAGCTCGTCCt | 3583 | taggaGGACGAGCTGCTATACTCt | 3584 |
| 2_IGHD6-6*01 | cgaaaAGTATAGCAGCTCGTCCGt | 3585 | taggaCGGACGAGCTGCTATACTt | 3586 |
| 1_IGHD6-13*01 | cgaaaGGGTATAGCAGCAGCTGGTACt | 3587 | taggaGTACCAGCTGCTGCTATACCCt | 3588 |
| 2_IGHD6-13*01 | cgaaaGGTATAGCAGCAGCTGGTACGt | 3589 | taggaCGTACCAGCTGCTGCTATACCt | 3590 |
| 1_IGHD6-19*01 | cgaaaGGGTATAGCAGTGGCTGGTACt | 3591 | taggaGTACCAGCCACTGCTATACCCt | 3592 |
| 2_IGHD6-19*01 | cgaaaGGTATAGCAGTGGCTGGTACGt | 3593 | taggaCGTACCAGCCACTGCTATACCt | 3594 |
| 1_IGHD6-25*01 | cgaaaGGGTATAGCAGCGGCTACt | 3595 | taggaGTAGCCGCTGCTATACCCt | 3596 |
| 2_IGHD6-25*01 | cgaaaGGTATAGCAGCGGCTACGt | 3597 | taggaCGTAGCCGCTGCTATACCt | 3598 |
| 1_IGHD7-27*01 | cgaaaCTAACTGGGGAGt | 3599 | taggaCTCCCCAGTTAGt | 3600 |
| 3_IGHD7-27*01 | cgaaaGCTAACTGGGGAt | 3601 | taggaTCCCCAGTTAGCt | 3602 |

TABLE 40

Inverted D$_H$ segment oligos

| D segment | Forward | SEQ ID NO | Reverse | SEQ ID NO |
|---|---|---|---|---|
| 1'_IGHD1-1*01 | cgaaaGTCGTTCCAGTTGTACCGt | 3603 | taggaCGGTACAACTGGAACGACt | 3604 |
| 2'_IGHD1-1*01 | cgaaaTCGTTCCAGTTGTACCGGt | 3605 | taggaCCGGTACAACTGGAACGAt | 3606 |
| 3'_IGHD1-1*01 | cgaaaGGTCGTTCCAGTTGTACCt | 3607 | taggaGGTACAACTGGAACGACCt | 3608 |
| 1'_IGHD1-7*01 | cgaaaGTAGTTCCAGTTATACCGt | 3609 | taggaCGGTATAACTGGAACTACt | 3610 |
| 3'_IGHD1-7*01 | cgaaaGGTAGTTCCAGTTATACCt | 3611 | taggaGGTATAACTGGAACTACCt | 3612 |
| 1'_IGHD1-14*01 | cgaaaGTGGTTCCGGTTATACCGt | 3613 | taggaCGGTATAACCGGAACCACt | 3614 |
| 2'_IGHD1-14*01 | cgaaaTGGTTCCGGTTATACCGGt | 3615 | taggaCCGGTATAACCGGAACCAt | 3616 |
| 3'_IGHD1-14*01 | cgaaaGGTGGTTCCGGTTATACCt | 3617 | taggaGGTATAACCGGAACCACCt | 3618 |
| 1'_IGHD1-20*01 | cgaaaGTCGTTCCAGTTATACCGt | 3619 | taggaCGGTATAACTGGAACGACt | 3620 |
| 2'_IGHD1-20*01 | cgaaaTCGTTCCAGTTATACCGGt | 3621 | taggaCCGGTATAACTGGAACGAt | 3622 |
| 3'_IGHD1-20*01 | cgaaaGGTCGTTCCAGTTATACCt | 3623 | taggaGGTATAACTGGAACGACCt | 3624 |
| 1'_IGHD1-26*01 | cgaaaGTAGTAGCTCCCACTATACCGt | 3625 | taggaCGGTATAGTGGGAGCTACTACt | 3626 |
| 3'_IGHD1-26*01 | cgaaaGGTAGTAGCTCCCACTATACCt | 3627 | taggaGGTATAGTGGGAGCTACTACt | 3628 |
| 1'_IGHD2-2*01 | cgaaaGGCATAGCAGCTGGTACTACTACAATATCCt | 3629 | taggaGGATATTGTAGTAGTACCAGCTGCTATGCCt | 3630 |
| 3'_IGHD2-2*01 | cgaaaGGGCATAGCAGCTGGTACTACTACAATATCt | 3631 | taggaGATATTGTAGTAGTACCAGCTGCTATGCCCt | 3632 |
| 1'_IGHD2-8*01 | cgaaaGGTATAGCATACACCATTAGTACAATATCCt | 3633 | taggaGGATATTGTACTAATGGTGTATGCTATACCt | 3634 |
| 1'_IGHD2-15*01 | cgaaaGGAGTAGCAGCTACCACCACTACAATATCCt | 3635 | taggaGGATATTGTAGTGGTGGTAGCTGCTACTCCt | 3636 |
| 3'_IGHD2-15*01 | cgaaaGGGAGTAGCAGCTACCACCACTACAATATCt | 3637 | taggaGATATTGTAGTGGTGGTAGCTGCTACTCCCt | 3638 |
| 1'_IGHD2-21*01 | cgaaaGGAATAGCAATCACCACCACAATATGCt | 3639 | taggaGCATATTGTGGTGGTGATTGCTATTCCt | 3640 |
| 3'_IGHD2-21*01 | cgaaaGGGAATAGCAATCACCACCACAATATGt | 3641 | taggaCATATTGTGGTGGTGATTGCTATTCCCt | 3642 |
| 1'_IGHD3-3*01 | cgaaaGGTATAATAACCACTCCAAAAATCGTAATAt | 3643 | taggaTATTACGATTTTTGGAGTGGTTATTATACCt | 3644 |
| 3'_IGHD3-3*01 | cgaaaGGGTATAATAACCACTCCAAAAATCGTAATt | 3645 | taggaATTACGATTTTTGGAGTGGTTATTATACCCt | 3646 |
| 1'_IGHD3-9*01 | cgaaaGTTATAATAACCAGTCAAAATATCGTAATAt | 3647 | taggaTATTACGATATTTTGACTGGTTATTATAACt | 3648 |
| 3'_IGHD3-9*01 | cgaaaGGTTATAATAACCAGTCAAATATCGTAATt | 3649 | taggaATTACGATATTTTGACTGGTTATTATAACCt | 3650 |
| 1'_IGHD3-10*01 | cgaaaGTTATAATAACTCCCCGAACCATAGTAATAt | 3651 | taggaTATTACTATGGTTCGGGGAGTTATTATAACt | 3652 |
| 3'_IGHD3-10*01 | cgaaaGGTTATAATAACTCCCCGAACCATAGTAATt | 3653 | taggaATTACTATGGTTCGGGGAGTTATTATAACCt | 3654 |
| 1'_IGHD3-16*01 | cgaaaGGTATAAGCATAACTCCCCCAAACGTAATCATAATAt | 3655 | taggaTATTATGATTACGTTTGGGGAGTTATGCTTATACCt | 3656 |
| 3'_IGHD3-16*01 | cgaaaGGGTATAAGCATAACTCCCCCAAACGTAATCATAATt | 3657 | taggaATTATGATTACGTTTGGGGGAGTTATGCTTATACCCt | 3658 |

TABLE 40-continued

Inverted D_H segment oligos

| D segment | Forward | SEQ ID NO | Reverse | SEQ ID NO |
|---|---|---|---|---|
| 1'_IGHD3-22*01 | cgaaaGTAGTAATAACCACTACTATCATAGTAATAt | 3659 | taggaTATTACTATGATAGTAGTGGTTATTACTACt | 3660 |
| 1'_IGHD4-4*01 (1) | cgaaaGTAGTTACTGTAGTCt | 3661 | taggaGACTACAGTAACTACt | 3662 |
| 3'_IGHD4-4*01 (1) | cgaaaGGTAGTTACTGTAGTt | 3663 | taggaACTACAGTAACTACCt | 3664 |
| 1'_IGHD4-11*01 (1) | cgaaaGTAGTTACTGTAGTCt | 3665 | taggaGACTACAGTAACTACt | 3666 |
| 3'_IGHD4-11*01 (1) | cgaaaGGTAGTTACTGTAGTt | 3667 | taggaACTACAGTAACTACCt | 3668 |
| 1'_IGHD4-17*01 | cgaaaGTAGTCACCGTAGTCt | 3669 | taggaGACTACGGTGACTACt | 3670 |
| 3'_IGHD4-17*01 | cgaaaGGTAGTCACCGTAGTt | 3671 | taggaACTACGGTGACTACCt | 3672 |
| 1'_IGHD4-23*01 | cgaaaGGAGTTACCACCGTAGTCt | 3673 | taggaGACTACGGTGGTAACTCCt | 3674 |
| 3'_IGHD4-23*01 | cgaaaGGGAGTTACCACCGTAGTt | 3675 | taggaACTACGGTGGTAACTCCCt | 3676 |
| 1'_IGHD5-5*01 (2) | cgaaaGTAACCATAGCTGTATCCACGt | 3677 | taggaCGTGGATACAGCTATGGTTACt | 3678 |
| 3'_IGHD5-5*01 (2) | cgaaaGGTAACCATAGCTGTATCCACt | 3679 | taggaGTGGATACAGCTATGGTTACCt | 3680 |
| 1'_IGHD5-12*01 | cgaaaGTAATCGTAGCCACTATATCCACGt | 3681 | taggaCGTGGATATAGTGGCTACGATTACt | 3682 |
| 3'_IGHD5-12*01 | cgaaaGGTAATCGTAGCCACTATATCCACt | 3683 | taggaGTGGATATAGTGGCTACGATTACCt | 3684 |
| 1'_IGHD5-18*01 (2) | cgaaaGTAACCATAGCTGTATCCACGt | 3685 | taggaCGTGGATACAGCTATGGTTACt | 3686 |
| 3'_IGHD5-18*01 (2) | cgaaaGGTAACCATAGCTGTATCCACt | 3687 | taggaGTGGATACAGCTATGGTTACCt | 3688 |
| 1'_IGHD5-24*01 | cgaaaGTAATTGTAGCCATCTCTACGt | 3689 | taggaCGTAGAGATGGCTACAATTACt | 3690 |
| 3'_IGHD5-24*01 | cgaaaGGTAATTGTAGCCATCTCTACt | 3691 | taggaGTAGAGATGGCTACAATTACCt | 3692 |
| 1'_IGHD6-6*01 | cgaaaGGACGAGCTGCTATACTCt | 3693 | taggaGAGTATAGCAGCTCGTCCt | 3694 |
| 2'_IGHD6-6*01 | cgaaaGACGAGCTGCTATACTCGt | 3695 | taggaCGAGTATAGCAGCTCGTCt | 3696 |
| 3'_IGHD6-6*01 | cgaaaGGGACGAGCTGCTATACTt | 3697 | taggaAGTATAGCAGCTCGTCCCt | 3698 |
| 1'_IGHD6-13*01 | cgaaaGTACCAGCTGCTGCTATACCCt | 3699 | taggaGGGTATAGCAGCAGCTGGTACt | 3700 |
| 2'_IGHD6-13*01 | cgaaaTACCAGCTGCTGCTATACCCGt | 3701 | taggaCGGGTATAGCAGCAGCTGGTAt | 3702 |
| 3'_IGHD6-13*01 | cgaaaGGTACCAGCTGCTGCTATACCt | 3703 | taggaGGTATAGCAGCAGCTGGTACCt | 3704 |
| 1'_IGHD6-19*01 | cgaaaGTACCAGCCACTGCTATACCCt | 3705 | taggaGGGTATAGCAGTGGCTGGTACt | 3706 |
| 2'_IGHD6-19*01 | cgaaaTACCAGCCACTGCTATACCCGt | 3707 | taggaCGGGTATAGCAGTGGCTGGTAt | 3708 |
| 3'_IGHD6-19*01 | cgaaaGGTACCAGCCACTGCTATACCt | 3709 | taggaGGTATAGCAGTGGCTGGTACCt | 3710 |
| 1'_IGHD6-25*01 | cgaaaGTAGCCGCTGCTATACCCt | 3711 | taggaGGGTATAGCAGCGGCTACt | 3712 |
| 3'_IGHD6-25*01 | cgaaaGGTAGCCGCTGCTATACCt | 3713 | taggaGGTATAGCAGCGGCTACCt | 3714 |

TABLE 40-continued

Inverted D_H segment oligos

| D segment | Forward | SEQ ID NO | Reverse | SEQ ID NO |
|---|---|---|---|---|
| 1'_IGHD7-27*01 | cgaaaTCCCCAGTTAGGt | 3715 | taggaCCTAACTGGGGAt | 3716 |
| 2'_IGHD7-27*01 | cgaaaCCCCAGTTAGGGt | 3717 | taggaCCCTAACTGGGGt | 3718 |

TABLE 41

VH3-23 Library

| No. | Heavy Chain | Nuc. SEQ ID NO | Prot. SEQ ID NO |
|---|---|---|---|
| 1 | >gi\|Fabrus\|VH3-23__IGHD1-1*01>1__IGHJ1*01 | 2070 | 2760 |
| 2 | >gi\|Fabrus\|VH3-23__IGHD1-1*01>2__IGHJ1*01 | 2071 | 2761 |
| 3 | >gi\|Fabrus\|VH3-23__IGHD1-1*01>3__IGHJ1*01 | 2072 | 2762 |
| 4 | >gi\|Fabrus\|VH3-23__IGHD1-7*01>1__IGHJ1*01 | 2073 | 2763 |
| 5 | >gi\|Fabrus\|VH3-23__IGHD1-7*01>3__IGHJ1*01 | 2074 | 2764 |
| 6 | >gi\|Fabrus\|VH3-23__IGHD1-14*01>1__IGHJ1*01 | 2075 | 2765 |
| 7 | >gi\|Fabrus\|VH3-23__IGHD1-14*01>3__IGHJ1*01 | 2076 | 2766 |
| 8 | >gi\|Fabrus\|VH3-23__IGHD1-20*01>1__IGHJ1*01 | 2077 | 2767 |
| 9 | >gi\|Fabrus\|VH3-23__IGHD1-20*01>3__IGHJ1*01 | 2078 | 2768 |
| 10 | >gi\|Fabrus\|VH3-23__IGHD1-26*01>1__IGHJ1*01 | 2079 | 2769 |
| 11 | >gi\|Fabrus\|VH3-23__IGHD1-26*01>3__IGHJ1*01 | 2080 | 2770 |
| 12 | >gi\|Fabrus\|VH3-23__IGHD2-2*01>2__IGHJ1*01 | 2081 | 2771 |
| 13 | >gi\|Fabrus\|VH3-23__IGHD2-2*01>3__IGHJ1*01 | 2082 | 2772 |
| 14 | >gi\|Fabrus\|VH3-23__IGHD2-8*01>2__IGHJ1*01 | 2083 | 2773 |
| 15 | >gi\|Fabrus\|VH3-23__IGHD2-8*01>3__IGHJ1*01 | 2084 | 2774 |
| 16 | >gi\|Fabrus\|VH3-23__IGHD2-15*01>2__IGHJ1*01 | 2085 | 2775 |
| 17 | >gi\|Fabrus\|VH3-23__IGHD2-15*01>3__IGHJ1*01 | 2086 | 2776 |
| 18 | >gi\|Fabrus\|VH3-23__IGHD2-21*01>2__IGHJ1*01 | 2087 | 2777 |
| 19 | >gi\|Fabrus\|VH3-23__IGHD2-21*01>3__IGHJ1*01 | 2088 | 2778 |
| 20 | >gi\|Fabrus\|VH3-23__IGHD3-3*01>1__IGHJ1*01 | 2089 | 2779 |
| 21 | >gi\|Fabrus\|VH3-23__IGHD3-3*01>2__IGHJ1*01 | 2090 | 2780 |
| 22 | >gi\|Fabrus\|VH3-23__IGHD3-3*01>3__IGHJ1*01 | 2091 | 2781 |
| 23 | >gi\|Fabrus\|VH3-23__IGHD3-9*01>2__IGHJ1*01 | 2092 | 2782 |
| 24 | >gi\|Fabrus\|VH3-23__IGHD3-10*01>2__IGHJ1*01 | 2093 | 2783 |
| 25 | >gi\|Fabrus\|VH3-23__IGHD3-10*01>3__IGHJ1*01 | 2094 | 2784 |
| 26 | >gi\|Fabrus\|VH3-23__IGHD3-16*01>2__IGHJ1*01 | 2095 | 2785 |
| 27 | >gi\|Fabrus\|VH3-23__IGHD3-16*01>3__IGHJ1*01 | 2096 | 2786 |
| 28 | >gi\|Fabrus\|VH3-23__IGHD3-22*01>2__IGHJ1*01 | 2097 | 2787 |
| 29 | >gi\|Fabrus\|VH3-23__IGHD3-22*01>3__IGHJ1*01 | 2098 | 2788 |
| 30 | >gi\|Fabrus\|VH3-23__IGHD4-4*01(1)>2__IGHJ1*01 | 2099 | 2789 |
| 31 | >gi\|Fabrus\|VH3-23__IGHD4-4*01(1)>3__IGHJ1*01 | 2100 | 2790 |
| 32 | >gi\|Fabrus\|VH3-23__IGHD4-11*01(1)>2__IGHJ1*01 | 2101 | 2791 |
| 33 | >gi\|Fabrus\|VH3-23__IGHD4-11*01(1)>3__IGHJ1*01 | 2102 | 2792 |
| 34 | >gi\|Fabrus\|VH3-23__IGHD4-17*01>2__IGHJ1*01 | 2103 | 2793 |
| 35 | >gi\|Fabrus\|VH3-23__IGHD4-17*01>3__IGHJ1*01 | 2104 | 2794 |
| 36 | >gi\|Fabrus\|VH3-23__IGHD4-23*01>2__IGHJ1*01 | 2105 | 2795 |
| 37 | >gi\|Fabrus\|VH3-23__IGHD4-23*01>3__IGHJ1*01 | 2106 | 2796 |
| 38 | >gi\|Fabrus\|VH3-23__IGHD5-5*01(2)>1__IGHJ1*01 | 2107 | 2797 |
| 39 | >gi\|Fabrus\|VH3-23__IGHD5-5*01(2)>2__IGHJ1*01 | 2108 | 2798 |
| 40 | >gi\|Fabrus\|VH3-23__IGHD5-5*01(2)>3__IGHJ1*01 | 2109 | 2799 |
| 41 | >gi\|Fabrus\|VH3-23__IGHD5-12*01>1__IGHJ1*01 | 2110 | 2800 |
| 42 | >gi\|Fabrus\|VH3-23__IGHD5-12*01>3__IGHJ1*01 | 2111 | 2801 |
| 43 | >gi\|Fabrus\|VH3-23__IGHD5-18*01(2)>1__IGHJ1*01 | 2112 | 2802 |
| 44 | >gi\|Fabrus\|VH3-23__IGHD5-18*01(2)>2__IGHJ1*01 | 2113 | 2803 |
| 45 | >gi\|Fabrus\|VH3-23__IGHD5-18*01(2)>3__IGHJ1*01 | 2114 | 2804 |
| 46 | >gi\|Fabrus\|VH3-23__IGHD5-24*01>1__IGHJ1*01 | 2115 | 2805 |
| 47 | >gi\|Fabrus\|VH3-23__IGHD5-24*01>3__IGHJ1*01 | 2116 | 2806 |
| 48 | >gi\|Fabrus\|VH3-23__IGHD6-6*01>1__IGHJ1*01 | 2117 | 2807 |
| 49 | >gi\|Fabrus\|VH3-23__IGHD6-6*01>2__IGHJ1*01 | 2118 | 2808 |
| 50 | >gi\|Fabrus\|VH3-23__IGHD6-13*01>1__IGHJ1*01 | 2119 | 2809 |
| 51 | >gi\|Fabrus\|VH3-23__IGHD6-13*01>2__IGHJ1*01 | 2120 | 2810 |
| 52 | >gi\|Fabrus\|VH3-23__IGHD6-19*01>1__IGHJ1*01 | 2121 | 2811 |
| 53 | >gi\|Fabrus\|VH3-23__IGHD6-19*01>2__IGHJ1*01 | 2122 | 2812 |
| 54 | >gi\|Fabrus\|VH3-23__IGHD6-25*01>1__IGHJ1*01 | 2123 | 2813 |
| 55 | >gi\|Fabrus\|VH3-23__IGHD6-25*01>2__IGHJ1*01 | 2124 | 2814 |
| 56 | >gi\|Fabrus\|VH3-23__IGHD7-27*01>1__IGHJ1*01 | 2125 | 2815 |
| 57 | >gi\|Fabrus\|VH3-23__IGHD7-27*01>3__IGHJ1*01 | 2126 | 2816 |
| 58 | >gi\|Fabrus\|VH3-23__IGHD1-1*01>1'__IGHJ1*01 | 2127 | 2817 |
| 59 | >gi\|Fabrus\|VH3-23__IGHD1-1*01>2'__IGHJ1*01 | 2128 | 2818 |

TABLE 41-continued

VH3-23 Library

| No. | Heavy Chain | Nuc. SEQ ID NO | Prot. SEQ ID NO |
|---|---|---|---|
| 60 | >gi|Fabrus|VH3-23__IGHD1-1*01>3'__IGHJ1*01 | 2129 | 2819 |
| 61 | >gi|Fabrus|VH3-23__IGHD1-7*01>1'__IGHJ1*01 | 2130 | 2820 |
| 62 | >gi|Fabrus|VH3-23__IGHD1-7*01>3'__IGHJ1*01 | 2131 | 2821 |
| 63 | >gi|Fabrus|VH3-23__IGHD1-14*01>1'__IGHJ1*01 | 2132 | 2822 |
| 64 | >gi|Fabrus|VH3-23__IGHD1-14*01>2'__IGHJ1*01 | 2133 | 2823 |
| 65 | >gi|Fabrus|VH3-23__IGHD1-14*01>3'__IGHJ1*01 | 2134 | 2824 |
| 66 | >gi|Fabrus|VH3-23__IGHD1-20*01>1'__IGHJ1*01 | 2135 | 2825 |
| 67 | >gi|Fabrus|VH3-23__IGHD1-20*01>2'__IGHJ1*01 | 2136 | 2826 |
| 68 | >gi|Fabrus|VH3-23__IGHD1-20*01>3'__IGHJ1*01 | 2137 | 2827 |
| 69 | >gi|Fabrus|VH3-23__IGHD1-26*01>1'__IGHJ1*01 | 2138 | 2828 |
| 70 | >gi|Fabrus|VH3-23__IGHD1-26*01>3'__IGHJ1*01 | 2139 | 2829 |
| 71 | >gi|Fabrus|VH3-23__IGHD2-2*01>1'__IGHJ1*01 | 2140 | 2830 |
| 72 | >gi|Fabrus|VH3-23__IGHD2-2*01>3'__IGHJ1*01 | 2141 | 2831 |
| 73 | >gi|Fabrus|VH3-23__IGHD2-8*01>1'__IGHJ1*01 | 2142 | 2832 |
| 74 | >gi|Fabrus|VH3-23__IGHD2-15*01>1'__IGHJ1*01 | 2143 | 2833 |
| 75 | >gi|Fabrus|VH3-23__IGHD2-15*01>3'__IGHJ1*01 | 2144 | 2834 |
| 76 | >gi|Fabrus|VH3-23__IGHD2-21*01>1'__IGHJ1*01 | 2145 | 2835 |
| 77 | >gi|Fabrus|VH3-23__IGHD2-21*01>3'__IGHJ1*01 | 2146 | 2836 |
| 78 | >gi|Fabrus|VH3-23__IGHD3-3*01>1'__IGHJ1*01 | 2147 | 2837 |
| 79 | >gi|Fabrus|VH3-23__IGHD3-3*01>3'__IGHJ1*01 | 2148 | 2838 |
| 80 | >gi|Fabrus|VH3-23__IGHD3-9*01>1'__IGHJ1*01 | 2149 | 2839 |
| 81 | >gi|Fabrus|VH3-23__IGHD3-9*01>3'__IGHJ1*01 | 2150 | 2840 |
| 82 | >gi|Fabrus|VH3-23__IGHD3-10*01>1'__IGHJ1*01 | 2151 | 2841 |
| 83 | >gi|Fabrus|VH3-23__IGHD3-10*01>3'__IGHJ1*01 | 2152 | 2842 |
| 84 | >gi|Fabrus|VH3-23__IGHD3-16*01>1'__IGHJ1*01 | 2153 | 2843 |
| 85 | >gi|Fabrus|VH3-23__IGHD3-16*01>3'__IGHJ1*01 | 2154 | 2844 |
| 86 | >gi|Fabrus|VH3-23__IGHD3-22*01>1'__IGHJ1*01 | 2155 | 2845 |
| 87 | >gi|Fabrus|VH3-23__IGHD4-4*01(1)>1'__IGHJ1*01 | 2156 | 2846 |
| 88 | >gi|Fabrus|VH3-23__IGHD4-4*01(1)>3'__IGHJ1*01 | 2157 | 2847 |
| 89 | >gi|Fabrus|VH3-23__IGHD4-11*01(1)>1'__IGHJ1*01 | 2158 | 2848 |
| 90 | >gi|Fabrus|VH3-23__IGHD4-11*01(1)>3'__IGHJ1*01 | 2159 | 2849 |
| 91 | >gi|Fabrus|VH3-23__IGHD4-17*01>1'__IGHJ1*01 | 2160 | 2850 |
| 92 | >gi|Fabrus|VH3-23__IGHD4-17*01>3'__IGHJ1*01 | 2161 | 2851 |
| 93 | >gi|Fabrus|VH3-23__IGHD4-23*01>1'__IGHJ1*01 | 2162 | 2852 |
| 94 | >gi|Fabrus|VH3-23__IGHD4-23*01>3'__IGHJ1*01 | 2163 | 2853 |
| 95 | >gi|Fabrus|VH3-23__IGHD5-5*01(2)>1'__IGHJ1*01 | 2164 | 2854 |
| 96 | >gi|Fabrus|VH3-23__IGHD5-5*01(2)>3'__IGHJ1*01 | 2165 | 2855 |
| 97 | >gi|Fabrus|VH3-23__IGHD5-12*01>1'__IGHJ1*01 | 2166 | 2856 |
| 98 | >gi|Fabrus|VH3-23__IGHD5-12*01>3'__IGHJ1*01 | 2167 | 2857 |
| 99 | >gi|Fabrus|VH3-23__IGHD5-18*01(2)>1'__IGHJ1*01 | 2168 | 2858 |
| 100 | >gi|Fabrus|VH3-23__IGHD5-18*01(2)>3'__IGHJ1*01 | 2169 | 2859 |
| 101 | >gi|Fabrus|VH3-23__IGHD5-24*01>1'__IGHJ1*01 | 2170 | 2860 |
| 102 | >gi|Fabrus|VH3-23__IGHD5-24*01>3'__IGHJ1*01 | 2171 | 2861 |
| 103 | >gi|Fabrus|VH3-23__IGHD6-6*01>1'__IGHJ1*01 | 2172 | 2862 |
| 104 | >gi|Fabrus|VH3-23__IGHD6-6*01>2'__IGHJ1*01 | 2173 | 2863 |
| 105 | >gi|Fabrus|VH3-23__IGHD6-6*01>3'__IGHJ1*01 | 2174 | 2864 |
| 106 | >gi|Fabrus|VH3-23__IGHD6-13*01>1'__IGHJ1*01 | 2175 | 2865 |
| 107 | >gi|Fabrus|VH3-23__IGHD6-13*01>2'__IGHJ1*01 | 2176 | 2866 |
| 108 | >gi|Fabrus|VH3-23__IGHD6-13*01>3'__IGHJ1*01 | 2177 | 2867 |
| 109 | >gi|Fabrus|VH3-23__IGHD6-19*01>1'__IGHJ1*01 | 2178 | 2868 |
| 110 | >gi|Fabrus|VH3-23__IGHD6-19*01>2'__IGHJ1*01 | 2179 | 2869 |
| 111 | >gi|Fabrus|VH3-23__IGHD6-19*01>3'__IGHJ1*01 | 2180 | 2870 |
| 112 | >gi|Fabrus|VH3-23__IGHD6-25*01>1'__IGHJ1*01 | 2181 | 2871 |
| 113 | >gi|Fabrus|VH3-23__IGHD6-25*01>3'__IGHJ1*01 | 2182 | 2872 |
| 114 | >gi|Fabrus|VH3-23__IGHD7-27*01>1'__IGHJ1*01 | 2183 | 2873 |
| 115 | >gi|Fabrus|VH3-23__IGHD7-27*01>2'__IGHJ1*01 | 2184 | 2874 |
| 116 | >gi|Fabrus|VH3-23__IGHD1-1*01>1__IGHJ2*01 | 2185 | 2875 |
| 117 | >gi|Fabrus|VH3-23__IGHD1-1*01>2__IGHJ2*01 | 2186 | 2876 |
| 118 | >gi|Fabrus|VH3-23__IGHD1-1*01>3__IGHJ2*01 | 2187 | 2877 |
| 119 | >gi|Fabrus|VH3-23__IGHD1-7*01>1__IGHJ2*01 | 2188 | 2878 |
| 120 | >gi|Fabrus|VH3-23__IGHD1-7*01>3__IGHJ2*01 | 2189 | 2879 |
| 121 | >gi|Fabrus|VH3-23__IGHD1-14*01>1__IGHJ2*01 | 2190 | 2880 |
| 122 | >gi|Fabrus|VH3-23__IGHD1-14*01>3__IGHJ2*01 | 2191 | 2881 |
| 123 | >gi|Fabrus|VH3-23__IGHD1-20*01>1__IGHJ2*01 | 2192 | 2882 |
| 124 | >gi|Fabrus|VH3-23__IGHD1-20*01>3__IGHJ2*01 | 2193 | 2883 |
| 125 | >gi|Fabrus|VH3-23__IGHD1-26*01>1__IGHJ2*01 | 2194 | 2884 |
| 126 | >gi|Fabrus|VH3-23__IGHD1-26*01>3__IGHJ2*01 | 2195 | 2885 |
| 127 | >gi|Fabrus|VH3-23__IGHD2-2*01>2__IGHJ2*01 | 2196 | 2886 |
| 128 | >gi|Fabrus|VH3-23__IGHD2-2*01>3__IGHJ2*01 | 2197 | 2887 |
| 129 | >gi|Fabrus|VH3-23__IGHD2-8*01>2__IGHJ2*01 | 2198 | 2888 |
| 130 | >gi|Fabrus|VH3-23__IGHD2-8*01>3__IGHJ2*01 | 2199 | 2889 |
| 131 | >gi|Fabrus|VH3-23__IGHD2-15*01>2__IGHJ2*01 | 2200 | 2890 |
| 132 | >gi|Fabrus|VH3-23__IGHD2-15*01>3__IGHJ2*01 | 2201 | 2891 |
| 133 | >gi|Fabrus|VH3-23__IGHD2-21*01>2__IGHJ2*01 | 2202 | 2892 |
| 134 | >gi|Fabrus|VH3-23__IGHD2-21*01>3__IGHJ2*01 | 2203 | 2893 |

TABLE 41-continued

VH3-23 Library

| No. | Heavy Chain | Nuc. SEQ ID NO | Prot. SEQ ID NO |
|---|---|---|---|
| 135 | >gi|Fabrus|VH3-23__IGHD3-3*01>1__IGHJ2*01 | 2204 | 2894 |
| 136 | >gi|Fabrus|VH3-23__IGHD3-3*01>2__IGHJ2*01 | 2205 | 2895 |
| 137 | >gi|Fabrus|VH3-23__IGHD3-3*01>3__IGHJ2*01 | 2206 | 2896 |
| 138 | >gi|Fabrus|VH3-23__IGHD3-9*01>2__IGHJ2*01 | 2207 | 2897 |
| 139 | >gi|Fabrus|VH3-23__IGHD3-10*01>2__IGHJ2*01 | 2208 | 2898 |
| 140 | >gi|Fabrus|VH3-23__IGHD3-10*01>3__IGHJ2*01 | 2209 | 2899 |
| 141 | >gi|Fabrus|VH3-23__IGHD3-16*01>2__IGHJ2*01 | 2210 | 2900 |
| 142 | >gi|Fabrus|VH3-23__IGHD3-16*01>3__IGHJ2*01 | 2211 | 2901 |
| 143 | >gi|Fabrus|VH3-23__IGHD3-22*01>2__IGHJ2*01 | 2212 | 2902 |
| 144 | >gi|Fabrus|VH3-23__IGHD3-22*01>3__IGHJ2*01 | 2213 | 2903 |
| 145 | >gi|Fabrus|VH3-23__IGHD4-4*01(1)>2__IGHJ2*01 | 2214 | 2904 |
| 146 | >gi|Fabrus|VH3-23__IGHD4-4*01(1)>3__IGHJ2*01 | 2215 | 2905 |
| 147 | >gi|Fabrus|VH3-23__IGHD4-11*01(1)>2__IGHJ2*01 | 2216 | 2906 |
| 148 | >gi|Fabrus|VH3-23__IGHD4-11*01(1)>3__IGHJ2*01 | 2217 | 2907 |
| 149 | >gi|Fabrus|VH3-23__IGHD4-17*01>2__IGHJ2*01 | 2218 | 2908 |
| 150 | >gi|Fabrus|VH3-23__IGHD4-17*01>3__IGHJ2*01 | 2219 | 2909 |
| 151 | >gi|Fabrus|VH3-23__IGHD4-23*01>2__IGHJ2*01 | 2220 | 2910 |
| 152 | >gi|Fabrus|VH3-23__IGHD4-23*01>3__IGHJ2*01 | 2221 | 2911 |
| 153 | >gi|Fabrus|VH3-23__IGHD5-5*01(2)>1__IGHJ2*01 | 2222 | 2912 |
| 154 | >gi|Fabrus|VH3-23__IGHD5-5*01(2)>2__IGHJ2*01 | 2223 | 2913 |
| 155 | >gi|Fabrus|VH3-23__IGHD5-5*01(2)>3__IGHJ2*01 | 2224 | 2914 |
| 156 | >gi|Fabrus|VH3-23__IGHD5-12*01>1__IGHJ2*01 | 2225 | 2915 |
| 157 | >gi|Fabrus|VH3-23__IGHD5-12*01>3__IGHJ2*01 | 2226 | 2916 |
| 158 | >gi|Fabrus|VH3-23__IGHD5-18*01(2)>1__IGHJ2*01 | 2227 | 2917 |
| 159 | >gi|Fabrus|VH3-23__IGHD5-18*01(2)>2__IGHJ2*01 | 2228 | 2918 |
| 160 | >gi|Fabrus|VH3-23__IGHD5-18*01(2)>3__IGHJ2*01 | 2229 | 2919 |
| 161 | >gi|Fabrus|VH3-23__IGHD5-24*01>1__IGHJ2*01 | 2230 | 2920 |
| 162 | >gi|Fabrus|VH3-23__IGHD5-24*01>3__IGHJ2*01 | 2231 | 2921 |
| 163 | >gi|Fabrus|VH3-23__IGHD6-6*01>1__IGHJ2*01 | 2232 | 2922 |
| 164 | >gi|Fabrus|VH3-23__IGHD6-6*01>2__IGHJ2*01 | 2233 | 2923 |
| 165 | >gi|Fabrus|VH3-23__IGHD6-13*01>1__IGHJ2*01 | 2234 | 2924 |
| 166 | >gi|Fabrus|VH3-23__IGHD6-13*01>2__IGHJ2*01 | 2235 | 2925 |
| 167 | >gi|Fabrus|VH3-23__IGHD6-19*01>1__IGHJ2*01 | 2236 | 2926 |
| 168 | >gi|Fabrus|VH3-23__IGHD6-19*01>2__IGHJ2*01 | 2237 | 2927 |
| 169 | >gi|Fabrus|E06__VH3-23__IGHD6-25*01>1__IGHJ2*01 | 2238 | 2928 |
| 170 | >gi|Fabrus|E07__VH3-23__IGHD6-25*01>2__IGHJ2*01 | 2239 | 2929 |
| 171 | >gi|Fabrus|E08__VH3-23__IGHD7-27*01>1__IGHJ2*01 | 2240 | 2930 |
| 172 | >gi|Fabrus|E09__VH3-23__IGHD7-27*01>3__IGHJ2*01 | 2241 | 2931 |
| 173 | >gi|Fabrus|A01__VH3-23__IGHD1-1*01>1'__IGHJ2*01 | 2242 | 2932 |
| 174 | >gi|Fabrus|A02__VH3-23__IGHD1-1*01>2'__IGHJ2*01 | 2243 | 2933 |
| 175 | >gi|Fabrus|A03__VH3-23__IGHD1-1*01>3'__IGHJ2*01 | 2244 | 2934 |
| 176 | >gi|Fabrus|A04__VH3-23__IGHD1-7*01>1'__IGHJ2*01 | 2245 | 2935 |
| 177 | >gi|Fabrus|A05__VH3-23__IGHD1-7*01>3'__IGHJ2*01 | 2246 | 2936 |
| 178 | >gi|Fabrus|A06__VH3-23__IGHD1-14*01>1'__IGHJ2*01 | 2247 | 2937 |
| 179 | >gi|Fabrus|A07__VH3-23__IGHD1-14*01>2'__IGHJ2*01 | 2248 | 2938 |
| 180 | >gi|Fabrus|A08__VH3-23__IGHD1-14*01>3'__IGHJ2*01 | 2249 | 2939 |
| 181 | >gi|Fabrus|A09__VH3-23__IGHD1-20*01>1'__IGHJ2*01 | 2250 | 2940 |
| 182 | >gi|Fabrus|A10__VH3-23__IGHD1-20*01>2'__IGHJ2*01 | 2251 | 2941 |
| 183 | >gi|Fabrus|A11__VH3-23__IGHD1-20*01>3'__IGHJ2*01 | 2252 | 2942 |
| 184 | >gi|Fabrus|A12__VH3-23__IGHD1-26*01>1'__IGHJ2*01 | 2253 | 2943 |
| 185 | >gi|Fabrus|B01__VH3-23__IGHD1-26*01>3'__IGHJ2*01 | 2254 | 2944 |
| 186 | >gi|Fabrus|B02__VH3-23__IGHD2-2*01>1'__IGHJ2*01 | 2255 | 2945 |
| 187 | >gi|Fabrus|B03__VH3-23__IGHD2-2*01>3'__IGHJ2*01 | 2256 | 2946 |
| 188 | >gi|Fabrus|B04__VH3-23__IGHD2-8*01>1'__IGHJ2*01 | 2257 | 2947 |
| 189 | >gi|Fabrus|B05__VH3-23__IGHD2-15*01>1'__IGHJ2*01 | 2258 | 2948 |
| 190 | >gi|Fabrus|B06__VH3-23__IGHD2-15*01>3'__IGHJ2*01 | 2259 | 2949 |
| 191 | >gi|Fabrus|B07__VH3-23__IGHD2-21*01>1'__IGHJ2*01 | 2260 | 2950 |
| 192 | >gi|Fabrus|B08__VH3-23__IGHD2-21*01>3'__IGHJ2*01 | 2261 | 2951 |
| 193 | >gi|Fabrus|B09__VH3-23__IGHD3-3*01>1'__IGHJ2*01 | 2262 | 2952 |
| 194 | >gi|Fabrus|B10__VH3-23__IGHD3-3*01>3'__IGHJ2*01 | 2263 | 2953 |
| 195 | >gi|Fabrus|B11__VH3-23__IGHD3-9*01>1'__IGHJ2*01 | 2264 | 2954 |
| 196 | >gi|Fabrus|B12__VH3-23__IGHD3-9*01>3'__IGHJ2*01 | 2265 | 2955 |
| 197 | >gi|Fabrus|C01__VH3-23__IGHD3-10*01>1'__IGHJ2*01 | 2266 | 2956 |
| 198 | >gi|Fabrus|C02__VH3-23__IGHD3-10*01>3'__IGHJ2*01 | 2267 | 2957 |
| 199 | >gi|Fabrus|C03__VH3-23__IGHD3-16*01>1'__IGHJ2*01 | 2268 | 2958 |
| 200 | >gi|Fabrus|C04__VH3-23__IGHD3-16*01>3'__IGHJ2*01 | 2269 | 2959 |
| 201 | >gi|Fabrus|C05__VH3-23__IGHD3-22*01>1'__IGHJ2*01 | 2270 | 2960 |
| 202 | >gi|Fabrus|C06__VH3-23__IGHD4-4*01(1)>1'__IGHJ2*01 | 2271 | 2961 |
| 203 | >gi|Fabrus|C07__VH3-23__IGHD4-4*01(1)>3'__IGHJ2*01 | 2272 | 2962 |
| 204 | >gi|Fabrus|C08__VH3-23__IGHD4-11*01(1)>1'__IGHJ2*01 | 2273 | 2963 |
| 205 | >gi|Fabrus|C09__VH3-23__IGHD4-11*01(1)>3'__IGHJ2*01 | 2274 | 2964 |
| 206 | >gi|Fabrus|C10__VH3-23__IGHD4-17*01>1'__IGHJ2*01 | 2275 | 2965 |
| 207 | >gi|Fabrus|C11__VH3-23__IGHD4-17*01>3'__IGHJ2*01 | 2276 | 2966 |
| 208 | >gi|Fabrus|C12__VH3-23__IGHD4-23*01>1'__IGHJ2*01 | 2277 | 2967 |
| 209 | >gi|Fabrus|D01__VH3-23__IGHD4-23*01>3'__IGHJ2*01 | 2278 | 2968 |

TABLE 41-continued

| | VH3-23 Library | | |
|---|---|---|---|
| No. | Heavy Chain | Nuc. SEQ ID NO | Prot. SEQ ID NO |
| 210 | >gi|Fabrus|D02__VH3-23__IGHD5-5*01(2)>1'__IGHJ2*01 | 2279 | 2969 |
| 211 | >gi|Fabrus|D03__VH3-23__IGHD5-5*01(2)>3'__IGHJ2*01 | 2280 | 2970 |
| 212 | >gi|Fabrus|D04__VH3-23__IGHD5-12*01>1'__IGHJ2*01 | 2281 | 2971 |
| 213 | >gi|Fabrus|D05__VH3-23__IGHD5-12*01>3'__IGHJ2*01 | 2282 | 2972 |
| 214 | >gi|Fabrus|D06__VH3-23__IGHD5-18*01(2)>1'__IGHJ2*01 | 2283 | 2973 |
| 215 | >gi|Fabrus|D07__VH3-23__IGHD5-18*01(2)>3'__IGHJ2*01 | 2284 | 2974 |
| 216 | >gi|Fabrus|D08__VH3-23__IGHD5-24*01>1'__IGHJ2*01 | 2285 | 2975 |
| 217 | >gi|Fabrus|D09__VH3-23__IGHD5-24*01>3'__IGHJ2*01 | 2286 | 2976 |
| 218 | >gi|Fabrus|D10__VH3-23__IGHD6-6*01>1'__IGHJ2*01 | 2287 | 2977 |
| 219 | >gi|Fabrus|D11__VH3-23__IGHD6-6*01>2'__IGHJ2*01 | 2288 | 2978 |
| 220 | >gi|Fabrus|D12__VH3-23__IGHD6-6*01>3'__IGHJ2*01 | 2289 | 2979 |
| 221 | >gi|Fabrus|E01__VH3-23__IGHD6-13*01>1'__IGHJ2*01 | 2290 | 2980 |
| 222 | >gi|Fabrus|E02__VH3-23__IGHD6-13*01>2'__IGHJ2*01 | 2291 | 2981 |
| 223 | >gi|Fabrus|E03__VH3-23__IGHD6-13*01>3'__IGHJ2*01 | 2292 | 2982 |
| 224 | >gi|Fabrus|E04__VH3-23__IGHD6-19*01>1'__IGHJ2*01 | 2293 | 2983 |
| 225 | >gi|Fabrus|E05__VH3-23__IGHD6-19*01>2'__IGHJ2*01 | 2294 | 2984 |
| 226 | >gi|Fabrus|E06__VH3-23__IGHD6-19*01>3'__IGHJ2*01 | 2295 | 2985 |
| 227 | >gi|Fabrus|E07__VH3-23__IGHD6-25*01>1'__IGHJ2*01 | 2296 | 2986 |
| 228 | >gi|Fabrus|E08__VH3-23__IGHD6-25*01>3'__IGHJ2*01 | 2297 | 2987 |
| 229 | >gi|Fabrus|E09__VH3-23__IGHD7-27*01>1'__IGHJ2*01 | 2298 | 2988 |
| 230 | >gi|Fabrus|E10__VH3-23__IGHD7-27*01>2'__IGHJ2*01 | 2299 | 2989 |
| 231 | >gi|Fabrus|A01__VH3-23__IGHD1-1*01>1__IGHJ3*01 | 2300 | 2990 |
| 232 | >gi|Fabrus|A02__VH3-23__IGHD1-1*01>2__IGHJ3*01 | 2301 | 2991 |
| 233 | >gi|Fabrus|A03__VH3-23__IGHD1-1*01>3__IGHJ3*01 | 2302 | 2992 |
| 234 | >gi|Fabrus|A04__VH3-23__IGHD1-7*01>1__IGHJ3*01 | 2303 | 2993 |
| 235 | >gi|Fabrus|A05__VH3-23__IGHD1-7*01>3__IGHJ3*01 | 2304 | 2994 |
| 236 | >gi|Fabrus|A06__VH3-23__IGHD1-14*01>1__IGHJ3*01 | 2305 | 2995 |
| 237 | >gi|Fabrus|A07__VH3-23__IGHD1-14*01>3__IGHJ3*01 | 2306 | 2996 |
| 238 | >gi|Fabrus|A08__VH3-23__IGHD1-20*01>1__IGHJ3*01 | 2307 | 2997 |
| 239 | >gi|Fabrus|A09__VH3-23__IGHD1-20*01>3__IGHJ3*01 | 2308 | 2998 |
| 240 | >gi|Fabrus|A10__VH3-23__IGHD1-26*01>1__IGHJ3*01 | 2309 | 2999 |
| 241 | >gi|Fabrus|A11__VH3-23__IGHD1-26*01>3__IGHJ3*01 | 2310 | 3000 |
| 242 | >gi|Fabrus|A12__VH3-23__IGHD2-2*01>2__IGHJ3*01 | 2311 | 3001 |
| 243 | >gi|Fabrus|B01__VH3-23__IGHD2-2*01>3__IGHJ3*01 | 2312 | 3002 |
| 244 | >gi|Fabrus|B02__VH3-23__IGHD2-8*01>2__IGHJ3*01 | 2313 | 3003 |
| 245 | >gi|Fabrus|B03__VH3-23__IGHD2-8*01>3__IGHJ3*01 | 2314 | 3004 |
| 246 | >gi|Fabrus|B04__VH3-23__IGHD2-15*01>2__IGHJ3*01 | 2315 | 3005 |
| 247 | >gi|Fabrus|B05__VH3-23__IGHD2-15*01>3__IGHJ3*01 | 2316 | 3006 |
| 248 | >gi|Fabrus|B06__VH3-23__IGHD2-21*01>2__IGHJ3*01 | 2317 | 3007 |
| 249 | >gi|Fabrus|B07__VH3-23__IGHD2-21*01>3__IGHJ3*01 | 2318 | 3008 |
| 250 | >gi|Fabrus|B08__VH3-23__IGHD3-3*01>1__IGHJ3*01 | 2319 | 3009 |
| 251 | >gi|Fabrus|B09__VH3-23__IGHD3-3*01>2__IGHJ3*01 | 2320 | 3010 |
| 252 | >gi|Fabrus|B10__VH3-23__IGHD3-3*01>3__IGHJ3*01 | 2321 | 3011 |
| 253 | >gi|Fabrus|B11__VH3-23__IGHD3-9*01>2__IGHJ3*01 | 2322 | 3012 |
| 254 | >gi|Fabrus|B12__VH3-23__IGHD3-10*01>2__IGHJ3*01 | 2323 | 3013 |
| 255 | >gi|Fabrus|C01__VH3-23__IGHD3-10*01>3__IGHJ3*01 | 2324 | 3014 |
| 256 | >gi|Fabrus|C02__VH3-23__IGHD3-16*01>2__IGHJ3*01 | 2325 | 3015 |
| 257 | >gi|Fabrus|C03__VH3-23__IGHD3-16*01>3__IGHJ3*01 | 2326 | 3016 |
| 258 | >gi|Fabrus|C04__VH3-23__IGHD3-22*01>2__IGHJ3*01 | 2327 | 3017 |
| 259 | >gi|Fabrus|C05__VH3-23__IGHD3-22*01>3__IGHJ3*01 | 2328 | 3018 |
| 260 | >gi|Fabrus|C06__VH3-23__IGHD4-4*01(1)>2__IGHJ3*01 | 2329 | 3019 |
| 261 | >gi|Fabrus|C07__VH3-23__IGHD4-4*01(1)>3__IGHJ3*01 | 2330 | 3020 |
| 262 | >gi|Fabrus|C08__VH3-23__IGHD4-11*01(1)>2__IGHJ3*01 | 2331 | 3021 |
| 263 | >gi|Fabrus|C09__VH3-23__IGHD4-11*01(1)>3__IGHJ3*01 | 2332 | 3022 |
| 264 | >gi|Fabrus|C10__VH3-23__IGHD4-17*01>2__IGHJ3*01 | 2333 | 3023 |
| 265 | >gi|Fabrus|C11__VH3-23__IGHD4-17*01>3__IGHJ3*01 | 2334 | 3024 |
| 266 | >gi|Fabrus|C12__VH3-23__IGHD4-23*01>2__IGHJ3*01 | 2335 | 3025 |
| 267 | >gi|Fabrus|D01__VH3-23__IGHD4-23*01>3__IGHJ3*01 | 2336 | 3026 |
| 268 | >gi|Fabrus|D02__VH3-23__IGHD5-5*01(2)>1__IGHJ3*01 | 2337 | 3027 |
| 269 | >gi|Fabrus|D03__VH3-23__IGHD5-5*01(2)>2__IGHJ3*01 | 2338 | 3028 |
| 270 | >gi|Fabrus|D04__VH3-23__IGHD5-5*01(2)>3__IGHJ3*01 | 2339 | 3029 |
| 271 | >gi|Fabrus|D05__VH3-23__IGHD5-12*01>1__IGHJ3*01 | 2340 | 3030 |
| 272 | >gi|Fabrus|D06__VH3-23__IGHD5-12*01>3__IGHJ3*01 | 2341 | 3031 |
| 273 | >gi|Fabrus|D07__VH3-23__IGHD5-18*01(2)>1__IGHJ3*01 | 2342 | 3032 |
| 274 | >gi|Fabrus|D08__VH3-23__IGHD5-18*01(2)>2__IGHJ3*01 | 2343 | 3033 |
| 275 | >gi|Fabrus|D09__VH3-23__IGHD5-18*01(2)>3__IGHJ3*01 | 2344 | 3034 |
| 276 | >gi|Fabrus|D10__VH3-23__IGHD5-24*01>1__IGHJ3*01 | 2345 | 3035 |
| 277 | >gi|Fabrus|D11__VH3-23__IGHD5-24*01>3__IGHJ3*01 | 2346 | 3036 |
| 278 | >gi|Fabrus|D12__VH3-23__IGHD6-6*01>1__IGHJ3*01 | 2347 | 3037 |
| 279 | >gi|Fabrus|E01__VH3-23__IGHD6-6*01>2__IGHJ3*01 | 2348 | 3038 |
| 280 | >gi|Fabrus|E02__VH3-23__IGHD6-13*01>1__IGHJ3*01 | 2349 | 3039 |
| 281 | >gi|Fabrus|E03__VH3-23__IGHD6-13*01>2__IGHJ3*01 | 2350 | 3040 |
| 282 | >gi|Fabrus|E04__VH3-23__IGHD6-19*01>1__IGHJ3*01 | 2351 | 3041 |
| 283 | >gi|Fabrus|E05__VH3-23__IGHD6-19*01>2__IGHJ3*01 | 2352 | 3042 |
| 284 | >gi|Fabrus|E06__VH3-23__IGHD6-25*01>1__IGHJ3*01 | 2353 | 3043 |

TABLE 41-continued

VH3-23 Library

| No. | Heavy Chain | Nuc. SEQ ID NO | Prot. SEQ ID NO |
|---|---|---|---|
| 285 | >gi\|Fabrus\|E07__VH3-23__IGHD6-25*01>2__IGHJ3*01 | 2354 | 3044 |
| 286 | >gi\|Fabrus\|E08__VH3-23__IGHD7-27*01>1__IGHJ3*01 | 2355 | 3045 |
| 287 | >gi\|Fabrus\|E09__VH3-23__IGHD7-27*01>3__IGHJ3*01 | 2356 | 3046 |
| 288 | >gi\|Fabrus\|A01__VH3-23__IGHD1-1*01>1'__IGHJ3*01 | 2357 | 3047 |
| 289 | >gi\|Fabrus\|A02__VH3-23__IGHD1-1*01>2'__IGHJ3*01 | 2358 | 3048 |
| 290 | >gi\|Fabrus\|A03__VH3-23__IGHD1-1*01>3'__IGHJ3*01 | 2359 | 3049 |
| 291 | >gi\|Fabrus\|A04__VH3-23__IGHD1-7*01>1'__IGHJ3*01 | 2360 | 3050 |
| 292 | >gi\|Fabrus\|A05__VH3-23__IGHD1-7*01>3'__IGHJ3*01 | 2361 | 3051 |
| 293 | >gi\|Fabrus\|A06__VH3-23__IGHD1-14*01>1'__IGHJ3*01 | 2362 | 3052 |
| 294 | >gi\|Fabrus\|A07__VH3-23__IGHD1-14*01>2'__IGHJ3*01 | 2363 | 3053 |
| 295 | >gi\|Fabrus\|A08__VH3-23__IGHD1-14*01>3'__IGHJ3*01 | 2364 | 3054 |
| 296 | >gi\|Fabrus\|A09__VH3-23__IGHD1-20*01>1'__IGHJ3*01 | 2365 | 3055 |
| 297 | >gi\|Fabrus\|A10__VH3-23__IGHD1-20*01>2'__IGHJ3*01 | 2366 | 3056 |
| 298 | >gi\|Fabrus\|A11__VH3-23__IGHD1-20*01>3'__IGHJ3*01 | 2367 | 3057 |
| 299 | >gi\|Fabrus\|A12__VH3-23__IGHD1-26*01>1'__IGHJ3*01 | 2368 | 3058 |
| 300 | >gi\|Fabrus\|B01__VH3-23__IGHD1-26*01>3'__IGHJ3*01 | 2369 | 3059 |
| 301 | >gi\|Fabrus\|B02__VH3-23__IGHD2-2*01>1'__IGHJ3*01 | 2370 | 3060 |
| 302 | >gi\|Fabrus\|B03__VH3-23__IGHD2-2*01>3'__IGHJ3*01 | 2371 | 3061 |
| 303 | >gi\|Fabrus\|B04__VH3-23__IGHD2-8*01>1'__IGHJ3*01 | 2372 | 3062 |
| 304 | >gi\|Fabrus\|B05__VH3-23__IGHD2-15*01>1'__IGHJ3*01 | 2373 | 3063 |
| 305 | >gi\|Fabrus\|B06__VH3-23__IGHD2-15*01>3'__IGHJ3*01 | 2374 | 3064 |
| 306 | >gi\|Fabrus\|B07__VH3-23__IGHD2-21*01>1'__IGHJ3*01 | 2375 | 3065 |
| 307 | >gi\|Fabrus\|B08__VH3-23__IGHD2-21*01>3'__IGHJ3*01 | 2376 | 3066 |
| 308 | >gi\|Fabrus\|B09__VH3-23__IGHD3-3*01>1'__IGHJ3*01 | 2377 | 3067 |
| 309 | >gi\|Fabrus\|B10__VH3-23__IGHD3-3*01>3'__IGHJ3*01 | 2378 | 3068 |
| 310 | >gi\|Fabrus\|B11__VH3-23__IGHD3-9*01>1'__IGHJ3*01 | 2379 | 3069 |
| 311 | >gi\|Fabrus\|B12__VH3-23__IGHD3-9*01>3'__IGHJ3*01 | 2380 | 3070 |
| 312 | >gi\|Fabrus\|C01__VH3-23__IGHD3-10*01>1'__IGHJ3*01 | 2381 | 3071 |
| 313 | >gi\|Fabrus\|C02__VH3-23__IGHD3-10*01>3'__IGHJ3*01 | 2382 | 3072 |
| 314 | >gi\|Fabrus\|C03__VH3-23__IGHD3-16*01>1'__IGHJ3*01 | 2383 | 3073 |
| 315 | >gi\|Fabrus\|C04__VH3-23__IGHD3-16*01>3'__IGHJ3*01 | 2384 | 3074 |
| 316 | >gi\|Fabrus\|C05__VH3-23__IGHD3-22*01>1'__IGHJ3*01 | 2385 | 3075 |
| 317 | >gi\|Fabrus\|C06__VH3-23__IGHD4-4*01(1)>1'__IGHJ3*01 | 2386 | 3076 |
| 318 | >gi\|Fabrus\|C07__VH3-23__IGHD4-4*01(1)>3'__IGHJ3*01 | 2387 | 3077 |
| 319 | >gi\|Fabrus\|C08__VH3-23__IGHD4-11*01(1)>1'__IGHJ3*01 | 2388 | 3078 |
| 320 | >gi\|Fabrus\|C09__VH3-23__IGHD4-11*01(1)>3'__IGHJ3*01 | 2389 | 3079 |
| 321 | >gi\|Fabrus\|C10__VH3-23__IGHD4-17*01>1'__IGHJ3*01 | 2390 | 3080 |
| 322 | >gi\|Fabrus\|C11__VH3-23__IGHD4-17*01>3'__IGHJ3*01 | 2391 | 3081 |
| 323 | >gi\|Fabrus\|C12__VH3-23__IGHD4-23*01>1'__IGHJ3*01 | 2392 | 3082 |
| 324 | >gi\|Fabrus\|D01__VH3-23__IGHD4-23*01>3'__IGHJ3*01 | 2393 | 3083 |
| 325 | >gi\|Fabrus\|D02__VH3-23__IGHD5-5*01(2)>1'__IGHJ3*01 | 2394 | 3084 |
| 326 | >gi\|Fabrus\|D03__VH3-23__IGHD5-5*01(2)>3'__IGHJ3*01 | 2395 | 3085 |
| 327 | >gi\|Fabrus\|D04__VH3-23__IGHD5-12*01>1'__IGHJ3*01 | 2396 | 3086 |
| 328 | >gi\|Fabrus\|D05__VH3-23__IGHD5-12*01>3'__IGHJ3*01 | 2397 | 3087 |
| 329 | >gi\|Fabrus\|D06__VH3-23__IGHD5-18*01(2)>1'__IGHJ3*01 | 2398 | 3088 |
| 330 | >gi\|Fabrus\|D07__VH3-23__IGHD5-18*01(2)>3'__IGHJ3*01 | 2399 | 3089 |
| 331 | >gi\|Fabrus\|D08__VH3-23__IGHD5-24*01>1'__IGHJ3*01 | 2400 | 3090 |
| 332 | >gi\|Fabrus\|D09__VH3-23__IGHD5-24*01>3'__IGHJ3*01 | 2401 | 3091 |
| 333 | >gi\|Fabrus\|D10__VH3-23__IGHD6-6*01>1'__IGHJ3*01 | 2402 | 3092 |
| 334 | >gi\|Fabrus\|D11__VH3-23__IGHD6-6*01>2'__IGHJ3*01 | 2403 | 3093 |
| 335 | >gi\|Fabrus\|D12__VH3-23__IGHD6-6*01>3'__IGHJ3*01 | 2404 | 3094 |
| 336 | >gi\|Fabrus\|E01__VH3-23__IGHD6-13*01>1'__IGHJ3*01 | 2405 | 3095 |
| 337 | >gi\|Fabrus\|E02__VH3-23__IGHD6-13*01>2'__IGHJ3*01 | 2406 | 3096 |
| 338 | >gi\|Fabrus\|E03__VH3-23__IGHD6-13*01>3'__IGHJ3*01 | 2407 | 3097 |
| 339 | >gi\|Fabrus\|E04__VH3-23__IGHD6-19*01>1'__IGHJ3*01 | 2408 | 3098 |
| 340 | >gi\|Fabrus\|E05__VH3-23__IGHD6-19*01>2'__IGHJ3*01 | 2409 | 3099 |
| 341 | >gi\|Fabrus\|E06__VH3-23__IGHD6-19*01>3'__IGHJ3*01 | 2410 | 3100 |
| 342 | >gi\|Fabrus\|E07__VH3-23__IGHD6-25*01>1'__IGHJ3*01 | 2411 | 3101 |
| 343 | >gi\|Fabrus\|E08__VH3-23__IGHD6-25*01>3'__IGHJ3*01 | 2412 | 3102 |
| 344 | >gi\|Fabrus\|E09__VH3-23__IGHD7-27*01>1'__IGHJ3*01 | 2413 | 3103 |
| 345 | >gi\|Fabrus\|E10__VH3-23__IGHD7-27*01>2'__IGHJ3*01 | 2414 | 3104 |
| 346 | >gi\|Fabrus\|A01__VH3-23__IGHD1-1*01>1__IGHJ4*01 | 2415 | 3105 |
| 347 | >gi\|Fabrus\|A02__VH3-23__IGHD1-1*01>2__IGHJ4*01 | 2416 | 3106 |
| 348 | >gi\|Fabrus\|A03__VH3-23__IGHD1-1*01>3__IGHJ4*01 | 2417 | 3107 |
| 349 | >gi\|Fabrus\|A04__VH3-23__IGHD1-7*01>1__IGHJ4*01 | 2418 | 3108 |
| 350 | >gi\|Fabrus\|A05__VH3-23__IGHD1-7*01>3__IGHJ4*01 | 2419 | 3109 |
| 351 | >gi\|Fabrus\|A06__VH3-23__IGHD1-14*01>1__IGHJ4*01 | 2420 | 3110 |
| 352 | >gi\|Fabrus\|A07__VH3-23__IGHD1-14*01>3__IGHJ4*01 | 2421 | 3111 |
| 353 | >gi\|Fabrus\|A08__VH3-23__IGHD1-20*01>1__IGHJ4*01 | 2422 | 3112 |
| 354 | >gi\|Fabrus\|A09__VH3-23__IGHD1-20*01>3__IGHJ4*01 | 2423 | 3113 |
| 355 | >gi\|Fabrus\|A10__VH3-23__IGHD1-26*01>1__IGHJ4*01 | 2424 | 3114 |
| 356 | >gi\|Fabrus\|A11__VH3-23__IGHD1-26*01>3__IGHJ4*01 | 2425 | 3115 |
| 357 | >gi\|Fabrus\|A12__VH3-23__IGHD2-2*01>2__IGHJ4*01 | 2426 | 3116 |
| 358 | >gi\|Fabrus\|B01__VH3-23__IGHD2-2*01>3__IGHJ4*01 | 2427 | 3117 |
| 359 | >gi\|Fabrus\|B02__VH3-23__IGHD2-8*01>2__IGHJ4*01 | 2428 | 3118 |

TABLE 41-continued

VH3-23 Library

| No. | Heavy Chain | Nuc. SEQ ID NO | Prot. SEQ ID NO |
|---|---|---|---|
| 360 | >gi|Fabrus|B03__VH3-23__IGHD2-8*01>3__IGHJ4*01 | 2429 | 3119 |
| 361 | >gi|Fabrus|B04__VH3-23__IGHD2-15*01>2__IGHJ4*01 | 2430 | 3120 |
| 362 | >gi|Fabrus|B05__VH3-23__IGHD2-15*01>3__IGHJ4*01 | 2431 | 3121 |
| 363 | >gi|Fabrus|B06__VH3-23__IGHD2-21*01>2__IGHJ4*01 | 2432 | 3122 |
| 364 | >gi|Fabrus|B07__VH3-23__IGHD2-21*01>3__IGHJ4*01 | 2433 | 3123 |
| 365 | >gi|Fabrus|B08__VH3-23__IGHD3-3*01>1__IGHJ4*01 | 2434 | 3124 |
| 366 | >gi|Fabrus|B09__VH3-23__IGHD3-3*01>2__IGHJ4*01 | 2435 | 3125 |
| 367 | >gi|Fabrus|B10__VH3-23__IGHD3-3*01>3__IGHJ4*01 | 2436 | 3126 |
| 368 | >gi|Fabrus|B11__VH3-23__IGHD3-9*01>2__IGHJ4*01 | 2437 | 3127 |
| 369 | >gi|Fabrus|B12__VH3-23__IGHD3-10*01>2__IGHJ4*01 | 2438 | 3128 |
| 370 | >gi|Fabrus|C01__VH3-23__IGHD3-10*01>3__IGHJ4*01 | 2439 | 3129 |
| 371 | >gi|Fabrus|C02__VH3-23__IGHD3-16*01>2__IGHJ4*01 | 2440 | 3130 |
| 372 | >gi|Fabrus|C03__VH3-23__IGHD3-16*01>3__IGHJ4*01 | 2441 | 3131 |
| 373 | >gi|Fabrus|C04__VH3-23__IGHD3-22*01>2__IGHJ4*01 | 2442 | 3132 |
| 374 | >gi|Fabrus|C05__VH3-23__IGHD3-22*01>3__IGHJ4*01 | 2443 | 3133 |
| 375 | >gi|Fabrus|C06__VH3-23__IGHD4-4*01(1)>2__IGHJ4*01 | 2444 | 3134 |
| 376 | >gi|Fabrus|C07__VH3-23__IGHD4-4*01(1)>3__IGHJ4*01 | 2445 | 3135 |
| 377 | >gi|Fabrus|C08__VH3-23__IGHD4-11*01(1)>2__IGHJ4*01 | 2446 | 3136 |
| 378 | >gi|Fabrus|C09__VH3-23__IGHD4-11*01(1)>3__IGHJ4*01 | 2447 | 3137 |
| 379 | >gi|Fabrus|C10__VH3-23__IGHD4-17*01>2__IGHJ4*01 | 2448 | 3138 |
| 380 | >gi|Fabrus|C11__VH3-23__IGHD4-17*01>3__IGHJ4*01 | 2449 | 3139 |
| 381 | >gi|Fabrus|C12__VH3-23__IGHD4-23*01>2__IGHJ4*01 | 2450 | 3140 |
| 382 | >gi|Fabrus|D01__VH3-23__IGHD4-23*01>3__IGHJ4*01 | 2451 | 3141 |
| 383 | >gi|Fabrus|D02__VH3-23__IGHD5-5*01(2)>1__IGHJ4*01 | 2452 | 3142 |
| 384 | >gi|Fabrus|D03__VH3-23__IGHD5-5*01(2)>2__IGHJ4*01 | 2453 | 3143 |
| 385 | >gi|Fabrus|D04__VH3-23__IGHD5-5*01(2)>3__IGHJ4*01 | 2454 | 3144 |
| 386 | >gi|Fabrus|D05__VH3-23__IGHD5-12*01>1__IGHJ4*01 | 2455 | 3145 |
| 387 | >gi|Fabrus|D06__VH3-23__IGHD5-12*01>3__IGHJ4*01 | 2456 | 3146 |
| 388 | >gi|Fabrus|D07__VH3-23__IGHD5-18*01(2)>1__IGHJ4*01 | 2457 | 3147 |
| 389 | >gi|Fabrus|D08__VH3-23__IGHD5-18*01(2)>2__IGHJ4*01 | 2458 | 3148 |
| 390 | >gi|Fabrus|D09__VH3-23__IGHD5-18*01(2)>3__IGHJ4*01 | 2459 | 3149 |
| 391 | >gi|Fabrus|D10__VH3-23__IGHD5-24*01>1__IGHJ4*01 | 2460 | 3150 |
| 392 | >gi|Fabrus|D11__VH3-23__IGHD5-24*01>3__IGHJ4*01 | 2461 | 3151 |
| 393 | >gi|Fabrus|D12__VH3-23__IGHD6-6*01>1__IGHJ4*01 | 2462 | 3152 |
| 394 | >gi|Fabrus|E01__VH3-23__IGHD6-6*01>2__IGHJ4*01 | 2463 | 3153 |
| 395 | >gi|Fabrus|E02__VH3-23__IGHD6-13*01>1__IGHJ4*01 | 2464 | 3154 |
| 396 | >gi|Fabrus|E03__VH3-23__IGHD6-13*01>2__IGHJ4*01 | 2465 | 3155 |
| 397 | >gi|Fabrus|E04__VH3-23__IGHD6-19*01>1__IGHJ4*01 | 2466 | 3156 |
| 398 | >gi|Fabrus|E05__VH3-23__IGHD6-19*01>2__IGHJ4*01 | 2467 | 3157 |
| 399 | >gi|Fabrus|E06__VH3-23__IGHD6-25*01>1__IGHJ4*01 | 2468 | 3158 |
| 400 | >gi|Fabrus|E07__VH3-23__IGHD6-25*01>2__IGHJ4*01 | 2469 | 3159 |
| 401 | >gi|Fabrus|E08__VH3-23__IGHD7-27*01>1__IGHJ4*01 | 2470 | 3160 |
| 402 | >gi|Fabrus|E09__VH3-23__IGHD7-27*01>3__IGHJ4*01 | 2471 | 3161 |
| 403 | >gi|Fabrus|A01__VH3-23__IGHD1-1*01>1'__IGHJ4*01 | 2472 | 3162 |
| 404 | >gi|Fabrus|A02__VH3-23__IGHD1-1*01>2'__IGHJ4*01 | 2473 | 3163 |
| 405 | >gi|Fabrus|A03__VH3-23__IGHD1-1*01>3'__IGHJ4*01 | 2474 | 3164 |
| 406 | >gi|Fabrus|A04__VH3-23__IGHD1-7*01>1'__IGHJ4*01 | 2475 | 3165 |
| 407 | >gi|Fabrus|A05__VH3-23__IGHD1-7*01>3'__IGHJ4*01 | 2476 | 3166 |
| 408 | >gi|Fabrus|A06__VH3-23__IGHD1-14*01>1'__IGHJ4*01 | 2477 | 3167 |
| 409 | >gi|Fabrus|A07__VH3-23__IGHD1-14*01>2'__IGHJ4*01 | 2478 | 3168 |
| 410 | >gi|Fabrus|A08__VH3-23__IGHD1-14*01>3'__IGHJ4*01 | 2479 | 3169 |
| 411 | >gi|Fabrus|A09__VH3-23__IGHD1-20*01>1'__IGHJ4*01 | 2480 | 3170 |
| 412 | >gi|Fabrus|A10__VH3-23__IGHD1-20*01>2'__IGHJ4*01 | 2481 | 3171 |
| 413 | >gi|Fabrus|A11__VH3-23__IGHD1-20*01>3'__IGHJ4*01 | 2482 | 3172 |
| 414 | >gi|Fabrus|A12__VH3-23__IGHD1-26*01>1'__IGHJ4*01 | 2483 | 3173 |
| 415 | >gi|Fabrus|B01__VH3-23__IGHD1-26*01>3'__IGHJ4*01 | 2484 | 3174 |
| 416 | >gi|Fabrus|B02__VH3-23__IGHD2-2*01>1'__IGHJ4*01 | 2485 | 3175 |
| 417 | >gi|Fabrus|B03__VH3-23__IGHD2-2*01>3'__IGHJ4*01 | 2486 | 3176 |
| 418 | >gi|Fabrus|B04__VH3-23__IGHD2-8*01>1'__IGHJ4*01 | 2487 | 3177 |
| 419 | >gi|Fabrus|B05__VH3-23__IGHD2-15*01>1'__IGHJ4*01 | 2488 | 3178 |
| 420 | >gi|Fabrus|B06__VH3-23__IGHD2-15*01>3'__IGHJ4*01 | 2489 | 3179 |
| 421 | >gi|Fabrus|B07__VH3-23__IGHD2-21*01>1'__IGHJ4*01 | 2490 | 3180 |
| 422 | >gi|Fabrus|B08__VH3-23__IGHD2-21*01>3'__IGHJ4*01 | 2491 | 3181 |
| 423 | >gi|Fabrus|B09__VH3-23__IGHD3-3*01>1'__IGHJ4*01 | 2492 | 3182 |
| 424 | >gi|Fabrus|B10__VH3-23__IGHD3-3*01>3'__IGHJ4*01 | 2493 | 3183 |
| 425 | >gi|Fabrus|B11__VH3-23__IGHD3-9*01>1'__IGHJ4*01 | 2494 | 3184 |
| 426 | >gi|Fabrus|B12__VH3-23__IGHD3-9*01>3'__IGHJ4*01 | 2495 | 3185 |
| 427 | >gi|Fabrus|C01__VH3-23__IGHD3-10*01>1'__IGHJ4*01 | 2496 | 3186 |
| 428 | >gi|Fabrus|C02__VH3-23__IGHD3-10*01>3'__IGHJ4*01 | 2497 | 3187 |
| 429 | >gi|Fabrus|C03__VH3-23__IGHD3-16*01>1'__IGHJ4*01 | 2498 | 3188 |
| 430 | >gi|Fabrus|C04__VH3-23__IGHD3-16*01>3'__IGHJ4*01 | 2499 | 3189 |
| 431 | >gi|Fabrus|C05__VH3-23__IGHD3-22*01>1'__IGHJ4*01 | 2500 | 3190 |
| 432 | >gi|Fabrus|C06__VH3-23__IGHD4-4*01(1)>1'__IGHJ4*01 | 2501 | 3191 |
| 433 | >gi|Fabrus|C07__VH3-23__IGHD4-4*01(1)>3'__IGHJ4*01 | 2502 | 3192 |
| 434 | >gi|Fabrus|C08__VH3-23__IGHD4-11*01(1)>1'__IGHJ4*01 | 2503 | 3193 |

TABLE 41-continued

| | VH3-23 Library | | |
|---|---|---|---|
| No. | Heavy Chain | Nuc. SEQ ID NO | Prot. SEQ ID NO |
| 435 | >gi|Fabrus|C09__VH3-23__IGHD4-11*01(1)>3'__IGHJ4*01 | 2504 | 3194 |
| 436 | >gi|Fabrus|C10__VH3-23__IGHD4-17*01>1'__IGHJ4*01 | 2505 | 3195 |
| 437 | >gi|Fabrus|C11__VH3-23__IGHD4-17*01>3'__IGHJ4*01 | 2506 | 3196 |
| 438 | >gi|Fabrus|C12__VH3-23__IGHD4-23*01>1'__IGHJ4*01 | 2507 | 3197 |
| 439 | >gi|Fabrus|D01__VH3-23__IGHD4-23*01>3'__IGHJ4*01 | 2508 | 3198 |
| 440 | >gi|Fabrus|D02__VH3-23__IGHD5-5*01(2)>1'__IGHJ4*01 | 2509 | 3199 |
| 441 | >gi|Fabrus|D03__VH3-23__IGHD5-5*01(2)>3'__IGHJ4*01 | 2510 | 3200 |
| 442 | >gi|Fabrus|D04__VH3-23__IGHD5-12*01>1'__IGHJ4*01 | 2511 | 3201 |
| 443 | >gi|Fabrus|D05__VH3-23__IGHD5-12*01>3'__IGHJ4*01 | 2512 | 3202 |
| 444 | >gi|Fabrus|D06__VH3-23__IGHD5-18*01(2)>1'__IGHJ4*01 | 2513 | 3203 |
| 445 | >gi|Fabrus|D07__VH3-23__IGHD5-18*01(2)>3'__IGHJ4*01 | 2514 | 3204 |
| 446 | >gi|Fabrus|D08__VH3-23__IGHD5-24*01>1'__IGHJ4*01 | 2515 | 3205 |
| 447 | >gi|Fabrus|D09__VH3-23__IGHD5-24*01>3'__IGHJ4*01 | 2516 | 3206 |
| 448 | >gi|Fabrus|D10__VH3-23__IGHD6-6*01>1'__IGHJ4*01 | 2517 | 3207 |
| 449 | >gi|Fabrus|D11__VH3-23__IGHD6-6*01>2'__IGHJ4*01 | 2518 | 3208 |
| 450 | >gi|Fabrus|D12__VH3-23__IGHD6-6*01>3'__IGHJ4*01 | 2519 | 3209 |
| 451 | >gi|Fabrus|E01__VH3-23__IGHD6-13*01>1'__IGHJ4*01 | 2520 | 3210 |
| 452 | >gi|Fabrus|E02__VH3-23__IGHD6-13*01>2'__IGHJ4*01 | 2521 | 3211 |
| 453 | >gi|Fabrus|E03__VH3-23__IGHD6-13*01>3'__IGHJ4*01 | 2522 | 3212 |
| 454 | >gi|Fabrus|E04__VH3-23__IGHD6-19*01>1'__IGHJ4*01 | 2523 | 3213 |
| 455 | >gi|Fabrus|E05__VH3-23__IGHD6-19*01>2'__IGHJ4*01 | 2524 | 3214 |
| 456 | >gi|Fabrus|E06__VH3-23__IGHD6-19*01>3'__IGHJ4*01 | 2525 | 3215 |
| 457 | >gi|Fabrus|E07__VH3-23__IGHD6-25*01>1'__IGHJ4*01 | 2526 | 3216 |
| 458 | >gi|Fabrus|E08__VH3-23__IGHD6-25*01>3'__IGHJ4*01 | 2527 | 3217 |
| 459 | >gi|Fabrus|E09__VH3-23__IGHD7-27*01>1'__IGHJ4*01 | 2528 | 3218 |
| 460 | >gi|Fabrus|E10__VH3-23__IGHD7-27*01>2'__IGHJ4*01 | 2529 | 3219 |
| 461 | >gi|Fabrus|A01__VH3-23__IGHD1-1*01>1__IGHJ5*01 | 2530 | 3220 |
| 462 | >gi|Fabrus|A02__VH3-23__IGHD1-1*01>2__IGHJ5*01 | 2531 | 3221 |
| 463 | >gi|Fabrus|A03__VH3-23__IGHD1-1*01>3__IGHJ5*01 | 2532 | 3222 |
| 464 | >gi|Fabrus|A04__VH3-23__IGHD1-7*01>1__IGHJ5*01 | 2533 | 3223 |
| 465 | >gi|Fabrus|A05__VH3-23__IGHD1-7*01>3__IGHJ5*01 | 2534 | 3224 |
| 466 | >gi|Fabrus|A06__VH3-23__IGHD1-14*01>1__IGHJ5*01 | 2535 | 3225 |
| 467 | >gi|Fabrus|A07__VH3-23__IGHD1-14*01>3__IGHJ5*01 | 2536 | 3226 |
| 468 | >gi|Fabrus|A08__VH3-23__IGHD1-20*01>1__IGHJ5*01 | 2537 | 3227 |
| 469 | >gi|Fabrus|A09__VH3-23__IGHD1-20*01>3__IGHJ5*01 | 2538 | 3228 |
| 470 | >gi|Fabrus|A10__VH3-23__IGHD1-26*01>1__IGHJ5*01 | 2539 | 3229 |
| 471 | >gi|Fabrus|A11__VH3-23__IGHD1-26*01>3__IGHJ5*01 | 2540 | 3230 |
| 472 | >gi|Fabrus|A12__VH3-23__IGHD2-2*01>2__IGHJ5*01 | 2541 | 3231 |
| 473 | >gi|Fabrus|B01__VH3-23__IGHD2-2*01>3__IGHJ5*01 | 2542 | 3232 |
| 474 | >gi|Fabrus|B02__VH3-23__IGHD2-8*01>2__IGHJ5*01 | 2543 | 3233 |
| 475 | >gi|Fabrus|B03__VH3-23__IGHD2-8*01>3__IGHJ5*01 | 2544 | 3234 |
| 476 | >gi|Fabrus|B04__VH3-23__IGHD2-15*01>2__IGHJ5*01 | 2545 | 3235 |
| 477 | >gi|Fabrus|B05__VH3-23__IGHD2-15*01>3__IGHJ5*01 | 2546 | 3236 |
| 478 | >gi|Fabrus|B06__VH3-23__IGHD2-21*01>2__IGHJ5*01 | 2547 | 3237 |
| 479 | >gi|Fabrus|B07__VH3-23__IGHD2-21*01>3__IGHJ5*01 | 2548 | 3238 |
| 480 | >gi|Fabrus|B08__VH3-23__IGHD3-3*01>1__IGHJ5*01 | 2549 | 3239 |
| 481 | >gi|Fabrus|B09__VH3-23__IGHD3-3*01>2__IGHJ5*01 | 2550 | 3240 |
| 482 | >gi|Fabrus|B10__VH3-23__IGHD3-3*01>3__IGHJ5*01 | 2551 | 3241 |
| 483 | >gi|Fabrus|B11__VH3-23__IGHD3-9*01>2__IGHJ5*01 | 2552 | 3242 |
| 484 | >gi|Fabrus|B12__VH3-23__IGHD3-10*01>2__IGHJ5*01 | 2553 | 3243 |
| 485 | >gi|Fabrus|C01__VH3-23__IGHD3-10*01>3__IGHJ5*01 | 2554 | 3244 |
| 486 | >gi|Fabrus|C02__VH3-23__IGHD3-16*01>2__IGHJ5*01 | 2555 | 3245 |
| 487 | >gi|Fabrus|C03__VH3-23__IGHD3-16*01>3__IGHJ5*01 | 2556 | 3246 |
| 488 | >gi|Fabrus|C04__VH3-23__IGHD3-22*01>2__IGHJ5*01 | 2557 | 3247 |
| 489 | >gi|Fabrus|C05__VH3-23__IGHD3-22*01>3__IGHJ5*01 | 2558 | 3248 |
| 490 | >gi|Fabrus|C06__VH3-23__IGHD4-4*01(1)>2__IGHJ5*01 | 2559 | 3249 |
| 491 | >gi|Fabrus|C07__VH3-23__IGHD4-4*01(1)>3__IGHJ5*01 | 2560 | 3250 |
| 492 | >gi|Fabrus|C08__VH3-23__IGHD4-11*01(1)>2__IGHJ5*01 | 2561 | 3251 |
| 493 | >gi|Fabrus|C09__VH3-23__IGHD4-11*01(1)>3__IGHJ5*01 | 2562 | 3252 |
| 494 | >gi|Fabrus|C10__VH3-23__IGHD4-17*01>2__IGHJ5*01 | 2563 | 3253 |
| 495 | >gi|Fabrus|C11__VH3-23__IGHD4-17*01>3__IGHJ5*01 | 2564 | 3254 |
| 496 | >gi|Fabrus|C12__VH3-23__IGHD4-23*01>2__IGHJ5*01 | 2565 | 3255 |
| 497 | >gi|Fabrus|D01__VH3-23__IGHD4-23*01>3__IGHJ5*01 | 2566 | 3256 |
| 498 | >gi|Fabrus|D02__VH3-23__IGHD5-5*01(2)>1__IGHJ5*01 | 2567 | 3257 |
| 499 | >gi|Fabrus|D03__VH3-23__IGHD5-5*01(2)>2__IGHJ5*01 | 2568 | 3258 |
| 500 | >gi|Fabrus|D04__VH3-23__IGHD5-5*01(2)>3__IGHJ5*01 | 2569 | 3259 |
| 501 | >gi|Fabrus|D05__VH3-23__IGHD5-12*01>1__IGHJ5*01 | 2570 | 3260 |
| 502 | >gi|Fabrus|D06__VH3-23__IGHD5-12*01>3__IGHJ5*01 | 2571 | 3261 |
| 503 | >gi|Fabrus|D07__VH3-23__IGHD5-18*01(2)>1__IGHJ5*01 | 2572 | 3262 |
| 504 | >gi|Fabrus|D08__VH3-23__IGHD5-18*01(2)>2__IGHJ5*01 | 2573 | 3263 |
| 505 | >gi|Fabrus|D09__VH3-23__IGHD5-18*01(2)>3__IGHJ5*01 | 2574 | 3264 |
| 506 | >gi|Fabrus|D10__VH3-23__IGHD5-24*01>1__IGHJ5*01 | 2575 | 3265 |
| 507 | >gi|Fabrus|D11__VH3-23__IGHD5-24*01>3__IGHJ5*01 | 2576 | 3266 |
| 508 | >gi|Fabrus|D12__VH3-23__IGHD6-6*01>1__IGHJ5*01 | 2577 | 3267 |
| 509 | >gi|Fabrus|E01__VH3-23__IGHD6-6*01>2__IGHJ5*01 | 2578 | 3268 |

TABLE 41-continued

VH3-23 Library

| No. | Heavy Chain | Nuc. SEQ ID NO | Prot. SEQ ID NO |
|---|---|---|---|
| 510 | >gi|Fabrus|E02__VH3-23__IGHD6-13*01>1'__IGHJ5*01 | 2579 | 3269 |
| 511 | >gi|Fabrus|E03__VH3-23__IGHD6-13*01>2'__IGHJ5*01 | 2580 | 3270 |
| 512 | >gi|Fabrus|E04__VH3-23__IGHD6-19*01>1'__IGHJ5*01 | 2581 | 3271 |
| 513 | >gi|Fabrus|E05__VH3-23__IGHD6-19*01>2'__IGHJ5*01 | 2582 | 3272 |
| 514 | >gi|Fabrus|E06__VH3-23__IGHD6-25*01>1'__IGHJ5*01 | 2583 | 3273 |
| 515 | >gi|Fabrus|E07__VH3-23__IGHD6-25*01>2'__IGHJ5*01 | 2584 | 3274 |
| 516 | >gi|Fabrus|E08__VH3-23__IGHD7-27*01>1'__IGHJ5*01 | 2585 | 3275 |
| 517 | >gi|Fabrus|E09__VH3-23__IGHD7-27*01>3'__IGHJ5*01 | 2586 | 3276 |
| 518 | >gi|Fabrus|A01__VH3-23__IGHD1-1*01>1'__IGHJ5*01 | 2587 | 3277 |
| 519 | >gi|Fabrus|A02__VH3-23__IGHD1-1*01>2'__IGHJ5*01 | 2588 | 3278 |
| 520 | >gi|Fabrus|A03__VH3-23__IGHD1-1*01>3'__IGHJ5*01 | 2589 | 3279 |
| 521 | >gi|Fabrus|A04__VH3-23__IGHD1-7*01>1'__IGHJ5*01 | 2590 | 3280 |
| 522 | >gi|Fabrus|A05__VH3-23__IGHD1-7*01>3'__IGHJ5*01 | 2591 | 3281 |
| 523 | >gi|Fabrus|A06__VH3-23__IGHD1-14*01>1'__IGHJ5*01 | 2592 | 3282 |
| 524 | >gi|Fabrus|A07__VH3-23__IGHD1-14*01>2'__IGHJ5*01 | 2593 | 3283 |
| 525 | >gi|Fabrus|A08__VH3-23__IGHD1-14*01>3'__IGHJ5*01 | 2594 | 3284 |
| 526 | >gi|Fabrus|A09__VH3-23__IGHD1-20*01>1'__IGHJ5*01 | 2595 | 3285 |
| 527 | >gi|Fabrus|A10__VH3-23__IGHD1-20*01>2'__IGHJ5*01 | 2596 | 3286 |
| 528 | >gi|Fabrus|A11__VH3-23__IGHD1-20*01>3'__IGHJ5*01 | 2597 | 3287 |
| 529 | >gi|Fabrus|A12__VH3-23__IGHD1-26*01>1'__IGHJ5*01 | 2598 | 3288 |
| 530 | >gi|Fabrus|B01__VH3-23__IGHD1-26*01>3'__IGHJ5*01 | 2599 | 3289 |
| 531 | >gi|Fabrus|B02__VH3-23__IGHD2-2*01>1'__IGHJ5*01 | 2600 | 3290 |
| 532 | >gi|Fabrus|B03__VH3-23__IGHD2-2*01>3'__IGHJ5*01 | 2601 | 3291 |
| 533 | >gi|Fabrus|B04__VH3-23__IGHD2-8*01>1'__IGHJ5*01 | 2602 | 3292 |
| 534 | >gi|Fabrus|B05__VH3-23__IGHD2-15*01>1'__IGHJ5*01 | 2603 | 3293 |
| 535 | >gi|Fabrus|B06__VH3-23__IGHD2-15*01>3'__IGHJ5*01 | 2604 | 3294 |
| 536 | >gi|Fabrus|B07__VH3-23__IGHD2-21*01>1'__IGHJ5*01 | 2605 | 3295 |
| 537 | >gi|Fabrus|B08__VH3-23__IGHD2-21*01>3'__IGHJ5*01 | 2606 | 3296 |
| 538 | >gi|Fabrus|B09__VH3-23__IGHD3-3*01>1'__IGHJ5*01 | 2607 | 3297 |
| 539 | >gi|Fabrus|B10__VH3-23__IGHD3-3*01>3'__IGHJ5*01 | 2608 | 3298 |
| 540 | >gi|Fabrus|B11__VH3-23__IGHD3-9*01>1'__IGHJ5*01 | 2609 | 3299 |
| 541 | >gi|Fabrus|B12__VH3-23__IGHD3-9*01>3'__IGHJ5*01 | 2610 | 3300 |
| 542 | >gi|Fabrus|C01__VH3-23__IGHD3-10*01>1'__IGHJ5*01 | 2611 | 3301 |
| 543 | >gi|Fabrus|C02__VH3-23__IGHD3-10*01>3'__IGHJ5*01 | 2612 | 3302 |
| 544 | >gi|Fabrus|C03__VH3-23__IGHD3-16*01>1'__IGHJ5*01 | 2613 | 3303 |
| 545 | >gi|Fabrus|C04__VH3-23__IGHD3-16*01>3'__IGHJ5*01 | 2614 | 3304 |
| 546 | >gi|Fabrus|C05__VH3-23__IGHD3-22*01>1'__IGHJ5*01 | 2615 | 3305 |
| 547 | >gi|Fabrus|C06__VH3-23__IGHD4-4*01(1)>1'__IGHJ5*01 | 2616 | 3306 |
| 548 | >gi|Fabrus|C07__VH3-23__IGHD4-4*01(1)>3'__IGHJ5*01 | 2617 | 3307 |
| 549 | >gi|Fabrus|C08__VH3-23__IGHD4-11*01(1)>1'__IGHJ5*01 | 2618 | 3308 |
| 550 | >gi|Fabrus|C09__VH3-23__IGHD4-11*01(1)>3'__IGHJ5*01 | 2619 | 3309 |
| 551 | >gi|Fabrus|C10__VH3-23__IGHD4-17*01>1'__IGHJ5*01 | 2620 | 3310 |
| 552 | >gi|Fabrus|C11__VH3-23__IGHD4-17*01>3'__IGHJ5*01 | 2621 | 3311 |
| 553 | >gi|Fabrus|C12__VH3-23__IGHD4-23*01>1'__IGHJ5*01 | 2622 | 3312 |
| 554 | >gi|Fabrus|D01__VH3-23__IGHD4-23*01>3'__IGHJ5*01 | 2623 | 3313 |
| 555 | >gi|Fabrus|D02__VH3-23__IGHD5-5*01(2)>1'__IGHJ5*01 | 2624 | 3314 |
| 556 | >gi|Fabrus|D03__VH3-23__IGHD5-5*01(2)>3'__IGHJ5*01 | 2625 | 3315 |
| 557 | >gi|Fabrus|D04__VH3-23__IGHD5-12*01>1'__IGHJ5*01 | 2626 | 3316 |
| 558 | >gi|Fabrus|D05__VH3-23__IGHD5-12*01>3'__IGHJ5*01 | 2627 | 3317 |
| 559 | >gi|Fabrus|D06__VH3-23__IGHD5-18*01(2)>1'__IGHJ5*01 | 2628 | 3318 |
| 560 | >gi|Fabrus|D07__VH3-23__IGHD5-18*01(2)>3'__IGHJ5*01 | 2629 | 3319 |
| 561 | >gi|Fabrus|D08__VH3-23__IGHD5-24*01>1'__IGHJ5*01 | 2630 | 3320 |
| 562 | >gi|Fabrus|D09__VH3-23__IGHD5-24*01>3'__IGHJ5*01 | 2631 | 3321 |
| 563 | >gi|Fabrus|D10__VH3-23__IGHD6-6*01>1'__IGHJ5*01 | 2632 | 3322 |
| 564 | >gi|Fabrus|D11__VH3-23__IGHD6-6*01>2'__IGHJ5*01 | 2633 | 3323 |
| 565 | >gi|Fabrus|D12__VH3-23__IGHD6-6*01>3'__IGHJ5*01 | 2634 | 3324 |
| 566 | >gi|Fabrus|E01__VH3-23__IGHD6-13*01>1'__IGHJ5*01 | 2635 | 3325 |
| 567 | >gi|Fabrus|E02__VH3-23__IGHD6-13*01>2'__IGHJ5*01 | 2636 | 3326 |
| 568 | >gi|Fabrus|E03__VH3-23__IGHD6-13*01>3'__IGHJ5*01 | 2637 | 3327 |
| 569 | >gi|Fabrus|E04__VH3-23__IGHD6-19*01>1'__IGHJ5*01 | 2638 | 3328 |
| 570 | >gi|Fabrus|E05__VH3-23__IGHD6-19*01>2'__IGHJ5*01 | 2639 | 3329 |
| 571 | >gi|Fabrus|E06__VH3-23__IGHD6-19*01>3'__IGHJ5*01 | 2640 | 3330 |
| 572 | >gi|Fabrus|E07__VH3-23__IGHD6-25*01>1'__IGHJ5*01 | 2641 | 3331 |
| 573 | >gi|Fabrus|E08__VH3-23__IGHD6-25*01>3'__IGHJ5*01 | 2642 | 3332 |
| 574 | >gi|Fabrus|E09__VH3-23__IGHD7-27*01>1'__IGHJ5*01 | 2643 | 3333 |
| 575 | >gi|Fabrus|E10__VH3-23__IGHD7-27*01>2'__IGHJ5*01 | 2644 | 3334 |
| 576 | >gi|Fabrus|A01__VH3-23__IGHD1-1*01>1__IGHJ6*01 | 2645 | 3335 |
| 577 | >gi|Fabrus|A02__VH3-23__IGHD1-1*01>2__IGHJ6*01 | 2646 | 3336 |
| 578 | >gi|Fabrus|A03__VH3-23__IGHD1-1*01>3__IGHJ6*01 | 2647 | 3337 |
| 579 | >gi|Fabrus|A04__VH3-23__IGHD1-7*01>1__IGHJ6*01 | 2648 | 3338 |
| 580 | >gi|Fabrus|A05__VH3-23__IGHD1-7*01>3__IGHJ6*01 | 2649 | 3339 |
| 581 | >gi|Fabrus|A06__VH3-23__IGHD1-14*01>1__IGHJ6*01 | 2650 | 3340 |
| 582 | >gi|Fabrus|A07__VH3-23__IGHD1-14*01>3__IGHJ6*01 | 2651 | 3341 |
| 583 | >gi|Fabrus|A08__VH3-23__IGHD1-20*01>1__IGHJ6*01 | 2652 | 3342 |
| 584 | >gi|Fabrus|A09__VH3-23__IGHD1-20*01>3__IGHJ6*01 | 2653 | 3343 |

TABLE 41-continued

| | VH3-23 Library | | |
|---|---|---|---|
| No. | Heavy Chain | Nuc. SEQ ID NO | Prot. SEQ ID NO |
| 585 | >gi|Fabrus|A10__VH3-23__IGHD1-26*01>1__IGHJ6*01 | 2654 | 3344 |
| 586 | >gi|Fabrus|A11__VH3-23__IGHD1-26*01>3__IGHJ6*01 | 2655 | 3345 |
| 587 | >gi|Fabrus|A12__VH3-23__IGHD2-2*01>2__IGHJ6*01 | 2656 | 3346 |
| 588 | >gi|Fabrus|B01__VH3-23__IGHD2-2*01>3__IGHJ6*01 | 2657 | 3347 |
| 589 | >gi|Fabrus|B02__VH3-23__IGHD2-8*01>2__IGHJ6*01 | 2658 | 3348 |
| 590 | >gi|Fabrus|B03__VH3-23__IGHD2-8*01>3__IGHJ6*01 | 2659 | 3349 |
| 591 | >gi|Fabrus|B04__VH3-23__IGHD2-15*01>2__IGHJ6*01 | 2660 | 3350 |
| 592 | >gi|Fabrus|B05__VH3-23__IGHD2-15*01>3__IGHJ6*01 | 2661 | 3351 |
| 593 | >gi|Fabrus|B06__VH3-23__IGHD2-21*01>2__IGHJ6*01 | 2662 | 3352 |
| 594 | >gi|Fabrus|B07__VH3-23__IGHD2-21*01>3__IGHJ6*01 | 2663 | 3353 |
| 595 | >gi|Fabrus|B08__VH3-23__IGHD3-3*01>1__IGHJ6*01 | 2664 | 3354 |
| 596 | >gi|Fabrus|B09__VH3-23__IGHD3-3*01>2__IGHJ6*01 | 2665 | 3355 |
| 597 | >gi|Fabrus|B10__VH3-23__IGHD3-3*01>3__IGHJ6*01 | 2666 | 3356 |
| 598 | >gi|Fabrus|B11__VH3-23__IGHD3-9*01>2__IGHJ6*01 | 2667 | 3357 |
| 599 | >gi|Fabrus|B12__VH3-23__IGHD3-10*01>2__IGHJ6*01 | 2668 | 3358 |
| 600 | >gi|Fabrus|C01__VH3-23__IGHD3-10*01>3__IGHJ6*01 | 2669 | 3359 |
| 601 | >gi|Fabrus|C02__VH3-23__IGHD3-16*01>2__IGHJ6*01 | 2670 | 3360 |
| 602 | >gi|Fabrus|C03__VH3-23__IGHD3-16*01>3__IGHJ6*01 | 2671 | 3361 |
| 603 | >gi|Fabrus|C04__VH3-23__IGHD3-22*01>2__IGHJ6*01 | 2672 | 3362 |
| 604 | >gi|Fabrus|C05__VH3-23__IGHD3-22*01>3__IGHJ6*01 | 2673 | 3363 |
| 605 | >gi|Fabrus|C06__VH3-23__IGHD4-4*01 (1)>2__IGHJ6*01 | 2674 | 3364 |
| 606 | >gi|Fabrus|C07__VH3-23__IGHD4-4*01(1)>3__IGHJ6*01 | 2675 | 3365 |
| 607 | >gi|Fabrus|C08__VH3-23__IGHD4-11*01(1)>2__IGHJ6*01 | 2676 | 3366 |
| 608 | >gi|Fabrus|C09__VH3-23__IGHD4-11*01(1)>3__IGHJ6*01 | 2677 | 3367 |
| 609 | >gi|Fabrus|C10__VH3-23__IGHD4-17*01>2__IGHJ6*01 | 2678 | 3368 |
| 610 | >gi|Fabrus|C11__VH3-23__IGHD4-17*01>3__IGHJ6*01 | 2679 | 3369 |
| 611 | >gi|Fabrus|C12__VH3-23__IGHD4-23*01>2__IGHJ6*01 | 2680 | 3370 |
| 612 | >gi|Fabrus|D01__VH3-23__IGHD4-23*01>3__IGHJ6*01 | 2681 | 3371 |
| 613 | >gi|Fabrus|D02__VH3-23__IGHD5-5*01(2)>1__IGHJ6*01 | 2682 | 3372 |
| 614 | >gi|Fabrus|D03__VH3-23__IGHD5-5*01(2)>2__IGHJ6*01 | 2683 | 3373 |
| 615 | >gi|Fabrus|D04__VH3-23__IGHD5-5*01(2)>3__IGHJ6*01 | 2684 | 3374 |
| 616 | >gi|Fabrus|D05__VH3-23__IGHD5-12*01>1__IGHJ6*01 | 2685 | 3375 |
| 617 | >gi|Fabrus|D06__VH3-23__IGHD5-12*01>3__IGHJ6*01 | 2686 | 3376 |
| 618 | >gi|Fabrus|D07__VH3-23__IGHD5-18*01(2)>1__IGHJ6*01 | 2687 | 3377 |
| 619 | >gi|Fabrus|D08__VH3-23__IGHD5-18*01(2)>2__IGHJ6*01 | 2688 | 3378 |
| 620 | >gi|Fabrus|D09__VH3-23__IGHD5-18*01(2)>3__IGHJ6*01 | 2689 | 3379 |
| 621 | >gi|Fabrus|D10__VH3-23__IGHD5-24*01>1__IGHJ6*01 | 2690 | 3380 |
| 622 | >gi|Fabrus|D11__VH3-23__IGHD5-24*01>3__IGHJ6*01 | 2691 | 3381 |
| 623 | >gi|Fabrus|D12__VH3-23__IGHD6-6*01>1__IGHJ6*01 | 2692 | 3382 |
| 624 | >gi|Fabrus|E01__VH3-23__IGHD6-6*01>2__IGHJ6*01 | 2693 | 3383 |
| 625 | >gi|Fabrus|E02__VH3-23__IGHD6-13*01>1__IGHJ6*01 | 2694 | 3384 |
| 626 | >gi|Fabrus|E03__VH3-23__IGHD6-13*01>2__IGHJ6*01 | 2695 | 3385 |
| 627 | >gi|Fabrus|E04__VH3-23__IGHD6-19*01>1__IGHJ6*01 | 2696 | 3386 |
| 628 | >gi|Fabrus|E05__VH3-23__IGHD6-19*01>2__IGHJ6*01 | 2697 | 3387 |
| 629 | >gi|Fabrus|E06__VH3-23__IGHD6-25*01>1__IGHJ6*01 | 2698 | 3388 |
| 630 | >gi|Fabrus|E07__VH3-23__IGHD6-25*01>2__IGHJ6*01 | 2699 | 3389 |
| 631 | >gi|Fabrus|E08__VH3-23__IGHD7-27*01>1__IGHJ6*01 | 2700 | 3390 |
| 632 | >gi|Fabrus|E09__VH3-23__IGHD7-27*01>3__IGHJ6*01 | 2701 | 3391 |
| 633 | >gi|Fabrus|A01__VH3-23__IGHD1-1*01>1'__IGHJ6*01 | 2702 | 3392 |
| 634 | >gi|Fabrus|A02__VH3-23__IGHD1-1*01>2'__IGHJ6*01 | 2703 | 3393 |
| 635 | >gi|Fabrus|A03__VH3-23__IGHD1-1*01>3'__IGHJ6*01 | 2704 | 3394 |
| 636 | >gi|Fabrus|A04__VH3-23__IGHD1-7*01>1'__IGHJ6*01 | 2705 | 3395 |
| 637 | >gi|Fabrus|A05__VH3-23__IGHD1-7*01>3'__IGHJ6*01 | 2706 | 3396 |
| 638 | >gi|Fabrus|A06__VH3-23__IGHD1-14*01>1'__IGHJ6*01 | 2707 | 3397 |
| 639 | >gi|Fabrus|A07__VH3-23__IGHD1-14*01>2'__IGHJ6*01 | 2708 | 3398 |
| 640 | >gi|Fabrus|A08__VH3-23__IGHD1-14*01>3'__IGHJ6*01 | 2709 | 3399 |
| 641 | >gi|Fabrus|A09__VH3-23__IGHD1-20*01>1'__IGHJ6*01 | 2710 | 3400 |
| 642 | >gi|Fabrus|A10__VH3-23__IGHD1-20*01>2'__IGHJ6*01 | 2711 | 3401 |
| 643 | >gi|Fabrus|A11__VH3-23__IGHD1-20*01>3'__IGHJ6*01 | 2712 | 3402 |
| 644 | >gi|Fabrus|A12__VH3-23__IGHD1-26*01>1'__IGHJ6*01 | 2713 | 3403 |
| 645 | >gi|Fabrus|B01__VH3-23__IGHD1-26*01>3'__IGHJ6*01 | 2714 | 3404 |
| 646 | >gi|Fabrus|B02__VH3-23__IGHD2-2*01>1'__IGHJ6*01 | 2715 | 3405 |
| 647 | >gi|Fabrus|B03__VH3-23__IGHD2-2*01>3'__IGHJ6*01 | 2716 | 3406 |
| 648 | >gi|Fabrus|B04__VH3-23__IGHD2-8*01>1'__IGHJ6*01 | 2717 | 3407 |
| 649 | >gi|Fabrus|B05__VH3-23__IGHD2-15*01>1'__IGHJ6*01 | 2718 | 3408 |
| 650 | >gi|Fabrus|B06__VH3-23__IGHD2-15*01>3'__IGHJ6*01 | 2719 | 3409 |
| 651 | >gi|Fabrus|B07__VH3-23__IGHD2-21*01>1'__IGHJ6*01 | 2720 | 3410 |
| 652 | >gi|Fabrus|B08__VH3-23__IGHD2-21*01>3'__IGHJ6*01 | 2721 | 3411 |
| 653 | >gi|Fabrus|B09__VH3-23__IGHD3-3*01>1'__IGHJ6*01 | 2722 | 3412 |
| 654 | >gi|Fabrus|B10__VH3-23__IGHD3-3*01>3'__IGHJ6*01 | 2723 | 3413 |
| 655 | >gi|Fabrus|B11__VH3-23__IGHD3-9*01>1'__IGHJ6*01 | 2724 | 3414 |
| 656 | >gi|Fabrus|B12__VH3-23__IGHD3-9*01>3'__IGHJ6*01 | 2725 | 3415 |
| 657 | >gi|Fabrus|C01__VH3-23__IGHD3-10*01>1'__IGHJ6*01 | 2726 | 3416 |
| 658 | >gi|Fabrus|C02__VH3-23__IGHD3-10*01>3'__IGHJ6*01 | 2727 | 3417 |
| 659 | >gi|Fabrus|C03__VH3-23__IGHD3-16*01>1'__IGHJ6*01 | 2728 | 3418 |

TABLE 41-continued

VH3-23 Library

| No. | Heavy Chain | Nuc. SEQ ID NO | Prot. SEQ ID NO |
|---|---|---|---|
| 660 | >gi|Fabrus|C04__VH3-23__IGHD3-16*01>3'__IGHJ6*01 | 2729 | 3419 |
| 661 | >gi|Fabrus|C05__VH3-23__IGHD3-22*01>1'__IGHJ6*01 | 2730 | 3420 |
| 662 | >gi|Fabrus|C06__VH3-23__IGHD4-4*01(1)>1'__IGHJ6*01 | 2731 | 3421 |
| 663 | >gi|Fabrus|C07__VH3-23__IGHD4-4*01(1)>3'__IGHJ6*01 | 2732 | 3422 |
| 664 | >gi|Fabrus|C08__VH3-23__IGHD4-11*01(1)>1'__IGHJ6*01 | 2733 | 3423 |
| 665 | >gi|Fabrus|C09__VH3-23__IGHD4-11*01(1)>3'__IGHJ6*01 | 2734 | 3424 |
| 666 | >gi|Fabrus|C10__VH3-23__IGHD4-17*01>1'__IGHJ6*01 | 2735 | 3425 |
| 667 | >gi|Fabrus|C11__VH3-23__IGHD4-17*01>3'__IGHJ6*01 | 2736 | 3426 |
| 668 | >gi|Fabrus|C12__VH3-23__IGHD4-23*01>1'__IGHJ6*01 | 2737 | 3427 |
| 669 | >gi|Fabrus|D01__VH3-23__IGHD4-23*01>3'__IGHJ6*01 | 2738 | 3428 |
| 670 | >gi|Fabrus|D02__VH3-23__IGHD5-5*01(2)>1'__IGHJ6*01 | 2739 | 3429 |
| 671 | >gi|Fabrus|D03__VH3-23__IGHD5-5*01(2)>3'__IGHJ6*01 | 2740 | 3430 |
| 672 | >gi|Fabrus|D04__VH3-23__IGHD5-12*01>1'__IGHJ6*01 | 2741 | 3431 |
| 673 | >gi|Fabrus|D05__VH3-23__IGHD5-12*01>3'__IGHJ6*01 | 2742 | 3432 |
| 674 | >gi|Fabrus|D06__VH3-23__IGHD5-18*01(2)>1'__IGHJ6*01 | 2743 | 3433 |
| 675 | >gi|Fabrus|D07__VH3-23__IGHD5-18*01(2)>3'__IGHJ6*01 | 2744 | 3434 |
| 676 | >gi|Fabrus|D08__VH3-23__IGHD5-24*01>1'__IGHJ6*01 | 2745 | 3435 |
| 677 | >gi|Fabrus|D09__VH3-23__IGHD5-24*01>3'__IGHJ6*01 | 2746 | 3436 |
| 678 | >gi|Fabrus|D10__VH3-23__IGHD6-6*01>1'__IGHJ6*01 | 2747 | 3437 |
| 679 | >gi|Fabrus|D11__VH3-23__IGHD6-6*01>2'__IGHJ6*01 | 2748 | 3438 |
| 680 | >gi|Fabrus|D12__VH3-23__IGHD6-6*01>3'__IGHJ6*01 | 2749 | 3439 |
| 681 | >gi|Fabrus|E01__VH3-23__IGHD6-13*01>1'__IGHJ6*01 | 2750 | 3440 |
| 682 | >gi|Fabrus|E02__VH3-23__IGHD6-13*01>2'__IGHJ6*01 | 2751 | 3441 |
| 683 | >gi|Fabrus|E03__VH3-23__IGHD6-13*01>3'__IGHJ6*01 | 2752 | 3442 |
| 684 | >gi|Fabrus|E04__VH3-23__IGHD6-19*01>1'__IGHJ6*01 | 2753 | 3443 |
| 685 | >gi|Fabrus|E05__VH3-23__IGHD6-19*01>2'__IGHJ6*01 | 2754 | 3444 |
| 686 | >gi|Fabrus|E06__VH3-23__IGHD6-19*01>3'__IGHJ6*01 | 2755 | 3445 |
| 687 | >gi|Fabrus|E07__VH3-23__IGHD6-25*01>1'__IGHJ6*01 | 2756 | 3446 |
| 688 | >gi|Fabrus|E08__VH3-23__IGHD6-25*01>3'__IGHJ6*01 | 2757 | 3447 |
| 689 | >gi|Fabrus|E09__VH3-23__IGHD7-27*01>1'__IGHJ6*01 | 2758 | 3448 |
| 690 | >gi|Fabrus|E10__VH3-23__IGHD7-27*01>2'__IGHJ6*01 | 2759 | 3449 |

Example 15

Electrochemiluminescence Binding Assay

The electrochemiluminescence (ECL) binding assay described in Example 13 was further used to screen a 5,376 member Fab library and 15 modified Fab antibodies set forth in rows 22-36 in Table 77 below for antibodies capable of binding to one of the nine different antigens. As noted in Example 13 above, data were analyzed by comparing the ECL signals for an antigen to the blank of each well. A signal to blank ratio of 4 or more was considered a "Hit" Fab.

Fifty-six (56) plates, each containing 96 different Fabs, were screened using the ECL assay. Thirty-six (36) Fabs were identified with specific binding affinity to one or more of the protein antigens, as indicated in Tables 42-44. Table 42, below, summarizes the results of the ECL assay, including the recombinant human target/protein antigen, the number of antibody hits per target and the % of hits per target (number of hits/5376 antibodies screened). Eleven Fabs were identified that bind to recombinant human delta-like protein 4 (DLL4) whereas only 2 hits were identified that bind to to recombinant human epidermal growth factor 2 (ErbB2). Ten Fabs were identified that bind to recombinant human erythropoietin receptor (Epo R) and 6 Fabs were identified that bind to recombinant human P-cadherin. Additionally, 3 Fabs were identified that bind to recombinant human epidermal growth factor 2 (ErbB2) and 3 Fabs were identified that bind to recombinant human Notch-1. Table 43, below, lists the 21 Fabs (including the heavy chain and light chain) that were identified as "hits" in the initial ECL screen. A "hit" was a Fab antibody with signal to blank ratio of greater than 4. The results of the initial MSD assay screen at a single Fab concentration are listed in Table 44 below. Table 44 lists the 21 Fabs (the Fab No. corresponds each of the Fabs identified in Table 43), the Fab concentration, the 9 recombinant human target/protein antigens, and the ECL signals from the initial MSD assay screen at the given Fab concentration.

TABLE 42

Summary of 5376 Fab Library ECL Screen

| rHuman Antigen | Number of Hits | % Per Target |
|---|---|---|
| ErbB2/Fc chimera | 2 | 0.037 |
| EGF R/Fc chimera | 3 | 0.056 |
| HGF R/Fc chimera | 0 | n/a |
| Notch-1/Fc chimera | 3 | 0.056 |
| CD44/Fc chimera | 0 | n/a |
| IGF-1 sR | 0 | n/a |
| P-cadherin/Fc chimera | 6 | 0.112 |
| Epo R/Fc chimera | 10 | 0.186 |
| DLL4 | 11 | 0.205 |

TABLE 43

Fab Antibody "Hits" identified in ECL Screen

| Fab No. | Heavy Chain | Light Chain |
|---|---|---|
| 1 | VH4-28__IGHD7-27*01__IGHJ1*01 | L2__IGKJ1*01 |
| 2 | VH4-31__IGHD7-27*01__IGHJ5*01 | L2__IGKJ1*01 |
| 3 | VH2-5__IGHD7-27*01__IGHJ2*01 | L2__IGKJ1*01 |
| 4 | VH1-46__IGHD7-27*01__IGHJ2*01 | A27__IGKJ1*01 |
| 5 | VH1-69__IGHD1-1*01__IGHJ6*01 | A17__IGKJ1*01 |
| 6 | VH1-46__IGHD2-15*01__IGHJ2*01 | L2__IGKJ1*01 |
| 7 | VH1-46__IGHD6-13*01__IGHJ4*01 | L2__IGKJ1*01 |
| 8 | VH4-34__IGHD7-27*01__IGHJ4*01 | L5__IGKJ1*01 |
| 9 | VH1-46__IGHD6-13*01__IGHJ4*01 | A27__IGKJ1*01 |
| 10 | VH1-46__IGHD7-27*01__IGHJ2*01 | L6__IGKJ1*01 |

TABLE 43-continued

Fab Antibody "Hits" identified in ECL Screen

| Fab No. | Heavy Chain | Light Chain |
|---|---|---|
| 11 | VH1-3__IGHD4-23*01__IGHJ4*01 | L12__IGKJ1*01 |
| 12 | VH1-46__IGHD2-15*01__IGHJ2*01 | L12__IGKJ1*01 |
| 13 | VH1-46__IGHD3-10*01__IGHJ4*01 | L12__IGKJ1*01 |
| 14 | VH1-8__IGHD2-2*01__IGHJ6*01 | L12__IGKJ1*01 |
| 15 | VH1-46__IGHD3-10*01__IGHJ4*01 | O1__IGKJ1*01 |
| 16 | VH1-46__IGHD6-13*01__IGHJ4*01 | O1__IGKJ1*01 |
| 17 | VH4-34__IGHD7-27*01__IGHJ4*01 | V1-4__IGLJ4*01 |
| 18 | VH4-31__IGHD2-15*01__IGHJ2*01 | V1-4__IGLJ4*01 |
| 19 | VH4-34__IGHD7-27*01__IGHJ4*01 | V4-6__IGLJ4*01 |
| 20 | VH3-23__IGHD3-10*01>3__IGHJ6*01 | O12__IGKJ1*01 |
| 21 | VH3-23__IGHD3-10*01>1'__IGHJ3*01 | O12__IGKJ1*01 |

TABLE 44

ECL Signals for Identified Fab "Hits" from 5376 Fab Library Screen

| Fab No. | [Fab] μM | ErbB2 | EGFR | HGFR | Notch-1 | CD44 | IGF-1 | P-cad | EPOR | DLL4 | Blank |
|---|---|---|---|---|---|---|---|---|---|---|---|
| 1 | 0.36 | 2028 | 3803 | 2034 | 3813 | 2482 | 1703 | 2741 | 19375 | 3911 | 1948 |
| 2 | 0.61 | 581 | 1222 | 539 | 1195 | 1048 | 596 | 782 | 3065 | 1006 | 570 |
| 3 | 0.03 | 2556 | 381 | 311 | 563 | 421 | 344 | 352 | 492 | 476 | 373 |
| 4 | 0.36 | 1474 | 1405 | 1225 | 1921 | 1542 | 1081 | 1795 | 2434 | 9082 | 928 |
| 5 | 0.65 | 2940 | 662 | 437 | 1336 | 797 | 656 | 695 | 922 | 849 | 441 |
| 6 | 0.25 | 15169 | 88015 | 5912 | 10346 | 10436 | 4929 | 16145 | 30118 | 14728 | 3693 |
| 7 | 1.19 | 18514 | 32030 | 17322 | 41739 | 27596 | 14089 | 34551 | 141492 | 39645 | 11543 |
| 8 | 0.51 | 1705 | 1807 | 1738 | 2876 | 1879 | 1742 | 3176 | 2563 | 5648 | 1393 |
| 9 | 0.48 | 6940 | 9043 | 6313 | 12759 | 9979 | 5468 | 15301 | 67194 | 13726 | 2877 |
| 10 | 1.56 | 2452 | 2497 | 3116 | 3953 | 2281 | 1919 | 5418 | 4129 | 3770 | 1129 |
| 11 | 0.06 | 1569 | 1755 | 1910 | 2232 | 1683 | 2325 | 2432 | 1973 | 13614 | 842 |
| 12 | 0.28 | 4314 | 8327 | 5182 | 5281 | 4561 | 4643 | 8057 | 8071 | 8151 | 1773 |
| 13 | 0.93 | 10795 | 15559 | 13790 | 23657 | 10634 | 13930 | 26366 | 16729 | 74294 | 4760 |
| 14 | 0.13 | 840 | 859 | 969 | 1324 | 932 | 1167 | 1641 | 1106 | 9848 | 786 |
| 15 | 1.57 | 904 | 1403 | 1039 | 1256 | 836 | 985 | 2029 | 6393 | 1496 | 797 |
| 16 | 0.93 | 1610 | 1855 | 2596 | 1918 | 1453 | 1787 | 2422 | 4241 | 9632 | 859 |
| 17 | 0.58 | 1262 | 1022 | 1706 | 739 | 761 | 1198 | 725 | 768 | 3128 | 403 |
| 18 | 0.21 | 1308 | 1297 | 1531 | 809 | 868 | 1557 | 915 | 885 | 3332 | 489 |
| 19 | 0.34 | 900 | 738 | 914 | 912 | 694 | 871 | 935 | 907 | 2561 | 356 |
| 20 | 0.12 | 4578 | 4060 | 5472 | 5501 | 4213 | 3137 | 17528 | 11210 | 6646 | 2225 |
| 21 | 0.42 | 702 | 759 | 935 | 919 | 748 | 844 | 3178 | 1504 | 922 | 450 |

To confirm a "Hit" identified in the intial ECL screening (see Tables 42-44 above), a Fab concentration dependent titration was carried out to determine the Fab-antigen binding affinity. The assay procedure was the same as described Example 13 above, except that the concentration of Fab antibody was varied between wells from 0.0628 nM to 1.57 μM. The results of the dose response assays are set forth in Tables 45-61 below. Tables 62-76 below list the results of the dose response assays for 15 modified anti-DLL4 antibodies (set forth in rows 22-36 of Table 77, below). The modified anti-DLL4 antibodies have at least one mutation in the heavy or light chain as compared to the previously identified germline antibodies.

TABLE 45

Binding affinity of Fab VH4-28__IGHD7-27*01__IGHJ1*01 & L2__IGKJ1*01

| Fab[nM] | 360 | 36 |
|---|---|---|
| ErbB2/Fc | 647 | 600 |
| EGF R/Fc | 957 | 711 |
| HGF R/Fc | 581 | 613 |
| Notch-1/Fc | 1026 | 773 |
| CD44/Fc | 740 | 679 |

TABLE 45-continued

Binding affinity of Fab VH4-28__IGHD7-27*01__IGHJ1*01 & L2__IGKJ1*01

| Fab[nM] | 360 | 36 |
|---|---|---|
| IGF-1 sR | 535 | 486 |
| P-Cadherin/Fc | 636 | 693 |
| EPO R/Fc | 4715 | 2977 |
| DLL4 | 866 | 799 |
| Blank | 462 | 413 |

TABLE 46

Binding affinity of Fab VH1-46__IGHD2-15*01__IGHJ2*01 & L2__IGKJ1*01

| Fab[μM] | 0.25 | 0.0625 | 0.01563 | 0.00391 |
|---|---|---|---|---|
| ErbB2/Fc | 29608 | 9033 | 4495 | 1667 |
| EGF R/Fc | 116674 | 94778 | 70836 | 35936 |
| HGF R/Fc | 13427 | 4108 | 1998 | 913 |
| Notch-1/Fc | 21447 | 5848 | 2800 | 1282 |
| CD44/Fc | 23015 | 6746 | 3182 | 1295 |
| IGF-1 sR | 11050 | 3150 | 1742 | 822 |
| P-Cadherin/Fc | 25459 | 7739 | 4945 | 1962 |
| EPO R/Fc | 49177 | 21136 | 11342 | 5022 |
| DLL4 | 27691 | 8051 | 4015 | 1551 |
| Blank | 6344 | 1738 | 906 | 576 |

TABLE 47

Binding affinity of Fab VH1-46__IGHD6-13*01__IGHJ4*01 & L2__IGKJ1*01

| Fab[μM] | 1.19 | 0.2975 | 0.07438 | 0.01859 |
|---|---|---|---|---|
| ErbB2/Fc | 38410 | 15111 | 7551 | 5531 |
| EGF R/Fc | 62454 | 42213 | 16605 | 11750 |

TABLE 47-continued

Binding affinity of Fab VH1-46_IGHD6-13*01_IGHJ4*01 & L2_IGKJ1*01

| Fab[µM]      | 1.19   | 0.2975 | 0.07438 | 0.01859 |
|--------------|--------|--------|---------|---------|
| HGF R/Fc     | 45494  | 17396  | 6611    | 4566    |
| Notch-1/Fc   | 72018  | 37503  | 21990   | 17565   |
| CD44/Fc      | 47145  | 28601  | 10922   | 7322    |
| IGF-1 sR     | 35187  | 17389  | 5804    | 3779    |
| P-Cadherin/Fc| 69710  | 26043  | 14807   | 11672   |
| EPO R/Fc     | 192967 | 167064 | 153692  | 188065  |
| DLL4         | 74900  | 34726  | 20719   | 18888   |
| Blank        | 24999  | 5019   | 2504    | 1776    |

TABLE 48

Binding affinity of Fab VH4-34_IGHD7-27*01_IGHJ4*01 & L5_IGKJ1*01

| Fab[µM]       | 0.51  | 0.1275 | 0.03188 | 0.00797 |
|---------------|-------|--------|---------|---------|
| ErbB2/Fc      | 1532  | 857    | 584     | 493     |
| EGF R/Fc      | 2363  | 1061   | 694     | 530     |
| HGF R/Fc      | 1989  | 853    | 693     | 419     |
| Notch-1/Fc    | 2773  | 1497   | 849     | 654     |
| CD44/Fc       | 2012  | 926    | 653     | 490     |
| IGF-1 sR      | 2236  | 1045   | 765     | 564     |
| P-Cadherin/Fc | 2389  | 957    | 775     | 502     |
| EPO R/Fc      | 2624  | 1067   | 789     | 566     |
| DLL4          | 5183  | 2382   | 1282    | 872     |
| Blank         | 1096  | 530    | 536     | 364     |

TABLE 49

Binding affinity of Fab VH1-46_IGHD6-13*01_IGHJ4*01 & A27_IGKJ1*01

| Fab[µM]       | 0.48  | 0.096 | 0.0192 |
|---------------|-------|-------|--------|
| ErbB2/Fc      | 11287 | 3365  | 2313   |
| EGF R/Fc      | 14638 | 4509  | 3115   |
| HGF R/Fc      | 8002  | 2328  | 1582   |
| Notch-1/Fc    | 15931 | 4802  | 3041   |
| CD44/Fc       | 13445 | 4320  | 2915   |
| IGF-1 sR      | 8927  | 2449  | 1826   |
| P-Cadherin/Fc | 15595 | 6654  | 5040   |
| EPO R/Fc      | 70938 | 57356 | 62037  |
| DLL4          | 16065 | 5586  | 3555   |
| Blank         | 2945  | 917   | 751    |

TABLE 50

Binding affinity of Fab VH1-46_IGHD7-27*01_IGHJ2*01 & L6_IGKJ1*01

| Fab[µM]       | 1.56  | 0.312 | 0.0624 |
|---------------|-------|-------|--------|
| ErbB2/Fc      | 7577  | 3659  | 2146   |
| EGF R/Fc      | 7832  | 4328  | 2415   |
| HGF R/Fc      | 10267 | 4691  | 2453   |
| Notch-1/Fc    | 9447  | 4462  | 2352   |
| CD44/Fc       | 7595  | 4171  | 2110   |
| IGF-1 sR      | 6913  | 3508  | 2034   |
| P-Cadherin/Fc | 15016 | 7098  | 4226   |
| EPO R/Fc      | 9480  | 5020  | 2678   |
| DLL4          | 10897 | 5484  | 2585   |
| Blank         | 4357  | 1977  | 960    |

TABLE 51

Binding affinity of Fab VH1-3_IGHD4-23*01_IGHJ4*01 & L12_IGKJ1*01

| Fab[nM]       | 60    | 15   | 3.75 | 0.9375 |
|---------------|-------|------|------|--------|
| ErbB2/Fc      | 2155  | 740  | 291  | 268    |
| EGF R/Fc      | 2563  | 842  | 371  | 224    |
| HGF R/Fc      | 2298  | 743  | 394  | 243    |
| Notch-1/Fc    | 2886  | 1058 | 375  | 348    |
| CD44/Fc       | 2355  | 748  | 307  | 251    |
| IGF-1 sR      | 2666  | 859  | 314  | 204    |
| P-Cadherin/Fc | 2662  | 837  | 331  | 191    |
| EPO R/Fc      | 3214  | 970  | 358  | 238    |
| DLL4          | 17270 | 7728 | 1569 | 453    |
| Blank         | 1433  | 536  | 191  | 153    |

TABLE 52

Binding affinity of Fab VH1-46_IGHD2-15*01_IGHJ2*01 & L12_IGKJ1*01

| Fab[nM]       | 280  | 70   | 17.5 | 4.375 |
|---------------|------|------|------|-------|
| ErbB2/Fc      | 3953 | 1358 | 541  | 384   |
| EGF R/Fc      | 6667 | 2574 | 1305 | 542   |
| HGF R/Fc      | 3564 | 1289 | 565  | 193   |
| Notch-1/Fc    | 4382 | 1492 | 680  | 480   |
| CD44/Fc       | 4069 | 1370 | 664  | 424   |
| IGF-1 sR      | 3533 | 1319 | 626  | 369   |
| P-Cadherin/Fc | 5400 | 1817 | 949  | 469   |
| EPO R/Fc      | 8496 | 2485 | 1262 | 594   |
| DLL4          | 8111 | 2747 | 1219 | 558   |
| Blank         | 1691 | 635  | 304  | 305   |

TABLE 53

Binding affinity of Fab VH1-46_IGHD3-10*01_IGHJ4*01 & L12_IGKJ1*01

| Fab[nM]       | 920   | 230    | 57.5   | 14.375 |
|---------------|-------|--------|--------|--------|
| ErbB2/Fc      | 10924 | 4078   | 2447   | 1594   |
| EGF R/Fc      | 13406 | 5723   | 3858   | 2672   |
| HGF R/Fc      | 10708 | 3934   | 2297   | 1600   |
| Notch-1/Fc    | 20086 | 9737   | 5886   | 4206   |
| CD44/Fc       | 9698  | 3817   | 2313   | 1488   |
| IGF-1 sR      | 10246 | 4764   | 2833   | 1746   |
| P-Cadherin/Fc | 16666 | 6484   | 4110   | 2318   |
| EPO R/Fc      | 16429 | 6949   | 4038   | 2718   |
| DLL4          | 73638 | 119436 | 144126 | 125422 |
| Blank         | 4082  | 1656   | 954    | 738    |

TABLE 54

Binding affinity of Fab VH1-8_IGHD2-2*01_IGHJ6*01 & L12_IGKJ1*01

| Fab[nM]       | 130  | 32.5 | 8.1  | 2.0 |
|---------------|------|------|------|-----|
| ErbB2/Fc      | 1533 | 556  | 557  | 382 |
| EGF R/Fc      | 1746 | 645  | 560  | 424 |
| HGF R/Fc      | 1882 | 525  | 551  | 356 |
| Notch-1/Fc    | 1759 | 706  | 612  | 539 |
| CD44/Fc       | 1754 | 573  | 528  | 447 |
| IGF-1 sR      | 1973 | 561  | 518  | 367 |
| P-Cadherin/Fc | 1845 | 556  | 573  | 250 |
| EPO R/Fc      | 2151 | 673  | 660  | 433 |
| DLL4          | 7738 | 2989 | 1548 | 605 |
| Blank         | 1153 | 473  | 435  | 316 |

TABLE 55

Binding affinity of Fab FabVH1-46_IGHD3-10*01_IGHJ4*01 & O1_IGKJ1*01

| Fab[nM]     | 1570 | 392.5 | 98.1 | 24.5 |
|-------------|------|-------|------|------|
| ErbB2/Fc    | 1263 | 539   | 247  | 241  |
| EGF R/Fc    | 2481 | 744   | 4386 | 317  |
| HGF R/Fc    | 1638 | 581   | 335  | 211  |
| Notch-1/Fc  | 1639 | 749   | 313  | 434  |
| CD44/Fc     | 1381 | 498   | 265  | 267  |
| IGF-1 sR    | 1428 | 466   | 309  | 239  |
| P-Cadherin/Fc | 1793 | 459 | 347  | 257  |
| EPO R/Fc    | 6121 | 5863  | 5628 | 4531 |
| DLL4        | 2701 | 735   | 402  | 339  |
| Blank       | 866  | 338   | 210  | 149  |

TABLE 56

Binding affinity of Fab VH1-46_IGHD6-13*01_IGHJ4*01 & O1_IGKJ1*01

| Fab[nM]     | 930  | 232.5 | 58.1 | 14.5 |
|-------------|------|-------|------|------|
| ErbB2/Fc    | 2225 | 779   | 322  | 274  |
| EGF R/Fc    | 3110 | 803   | 444  | 357  |
| HGF R/Fc    | 2344 | 790   | 432  | 373  |
| Notch-1/Fc  | 2206 | 778   | 388  | 317  |
| CD44/Fc     | 1917 | 607   | 375  | 212  |
| IGF-1 sR    | 1915 | 569   | 343  | 234  |
| P-Cadherin/Fc | 2438 | 655 | 478  | 277  |
| EPO R/Fc    | 3009 | 1472  | 829  | 660  |
| DLL4        | 8162 | 3586  | 1876 | 1149 |
| Blank       | 1206 | 460   | 225  | 117  |

TABLE 57

Binding affinity of Fab VH4-34_IGHD7-27*01_IGHJ4*01 & V1-4_IGLJ4*01

| Fab[nM]     | 580  | 145  | 36.3 | 9.1  |
|-------------|------|------|------|------|
| ErbB2/Fc    | 1712 | 1123 | 1029 | 987  |
| EGF R/Fc    | 1631 | 856  | 831  | 800  |
| HGF R/Fc    | 2341 | 1173 | 1065 | 894  |
| Notch-1/Fc  | 1585 | 860  | 633  | 754  |
| CD44/Fc     | 1228 | 692  | 629  | 607  |
| IGF-1 sR    | 1364 | 794  | 799  | 788  |
| P-Cadherin/Fc | 2240 | 850 | 684 | 589  |
| EPO R/Fc    | 1579 | 845  | 722  | 697  |
| DLL4        | 4420 | 2140 | 1399 | 1030 |
| Blank       | 679  | 357  | 314  | 276  |

TABLE 58

Binding affinity of Fab VH4-31_IGHD2-15*01_IGHJ2*01 & V1-4_IGLJ4*01

| Fab[nM]     | 210  | 52.5 | 13.1 | 3.3  |
|-------------|------|------|------|------|
| ErbB2/Fc    | 1977 | 1511 | 930  | 1031 |
| EGF R/Fc    | 1617 | 1109 | 824  | 847  |
| HGF R/Fc    | 2060 | 1286 | 981  | 849  |
| Notch-1/Fc  | 1972 | 1323 | 669  | 726  |
| CD44/Fc     | 1395 | 897  | 708  | 621  |
| IGF-1 sR    | 1431 | 911  | 814  | 743  |
| P-Cadherin/Fc | 4410 | 2161 | 1062 | 678 |
| EPO R/Fc    | 2123 | 1319 | 776  | 695  |
| DLL4        | 4108 | 1951 | 1107 | 922  |
| Blank       | 833  | 467  | 376  | 359  |

TABLE 59

Binding affinity of Fab VH4-34_IGHD7-27*01_IGHJ4*01 & V4-6_IGLJ4*01

| Fab[nM]     | 340  | 170  | 85.0 | 42.5 |
|-------------|------|------|------|------|
| ErbB2/Fc    | 1226 | 964  | 844  | 866  |
| EGF R/Fc    | 1208 | 826  | 1001 | 528  |
| HGF R/Fc    | 1238 | 757  | 998  | 607  |
| Notch-1/Fc  | 1209 | 816  | 780  | 649  |
| CD44/Fc     | 959  | 660  | 693  | 522  |
| IGF-1 sR    | 1042 | 832  | 891  | 646  |
| P-Cadherin/Fc | 1160 | 744 | 709  | 421  |
| EPO R/Fc    | 1255 | 790  | 817  | 494  |
| DLL4        | 2332 | 1462 | 1311 | 877  |
| Blank       | 554  | 262  | 292  | 162  |

TABLE 60

Binding affinity of Fab VH3-23_IGHD3-10*01>3_IGHJ6*01 & O12_IGKJ1*01

| Fab[nM]     | 120   | 12    | 1.2  | 0.12 |
|-------------|-------|-------|------|------|
| ErbB2/Fc    | 17294 | 4358  | 677  | 287  |
| EGF R/Fc    | 14925 | 1984  | 464  | 272  |
| HGF R/Fc    | 15917 | 2703  | 412  | 287  |
| Notch-1/Fc  | 14382 | 2582  | 660  | 218  |
| CD44/Fc     | 13519 | 1321  | 341  | 291  |
| IGF-1 sR    | 13265 | 1135  | 181  | 175  |
| P-Cadherin/Fc | 61714 | 28490 | 1684 | 318 |
| EPO R/Fc    | 33268 | 10966 | 1014 | 260  |
| DLL4        | 20627 | 2510  | 319  | 210  |
| Blank       | 6749  | 573   | 227  | 264  |

TABLE 61

Binding affinity of Fab VH3-23_IGHD3-10*01>1'_IGHJ3*01 & O12_IGKJ1*01

| Fab[nM]     | 421.12 | 42.112 |
|-------------|--------|--------|
| ErbB2/Fc    | 868    | 524    |
| EGF R/Fc    | 765    | 422    |
| HGF R/Fc    | 1202   | 565    |
| Notch-1/Fc  | 1061   | 437    |
| CD44/Fc     | 903    | 360    |
| IGF-1 sR    | 1065   | 364    |
| P-Cadherin/Fc | 2949 | 1546   |
| EPO R/Fc    | 1299   | 759    |
| DLL4        | 1090   | 404    |
| Blank       | 639    | 323    |

TABLE 62

Binding affinity of Fab VH5-51_IGHD5-18*01>3_IGHJ4*01_G100K & V3-4_IGLJ1*01

| Fab[nM]     | 1000  | 200   | 40    | 8     | 1.6  |
|-------------|-------|-------|-------|-------|------|
| ErbB2/Fc    | 1251  | 1467  | 1394  | 1232  | 1320 |
| EGF R/Fc    | 1029  | 1371  | 1149  | 1033  | 1180 |
| HGF R/Fc    | 1199  | 1428  | 1306  | 1260  | 1438 |
| Notch-1/Fc  | 1176  | 1247  | 875   | 831   | 816  |
| CD44/Fc     | 1025  | 1162  | 857   | 853   | 938  |
| IGF-1 sR    | 1134  | 1320  | 1271  | 1203  | 1437 |
| P-Cadherin/Fc | 1043 | 1126 | 744   | 788   | 811  |
| EPO R/Fc    | 1122  | 1226  | 979   | 881   | 899  |
| DLL4        | 29554 | 45421 | 35876 | 11408 | 2423 |
| Blank       | 630   | 588   | 518   | 489   | 565  |

TABLE 63

Binding affinity of Fab VH5-51__IGHD5-18*01>3__IGHJ4*01__G100R & V3-4__IGLJ1*01

| Fab[nM] | 1000 | 200 | 40 | 8 | 1.6 | 0.32 |
|---|---|---|---|---|---|---|
| ErbB2/Fc | 945 | 1448 | 1421 | 1326 | 1439 | 1485 |
| EGF R/Fc | 721 | 1017 | 1113 | 1078 | 1204 | 1221 |
| HGF R/Fc | 778 | 1164 | 1234 | 1240 | 1206 | 1287 |
| Notch-1/Fc | 761 | 1330 | 1014 | 916 | 1052 | 983 |
| CD44/FC | 559 | 895 | 824 | 786 | 997 | 877 |
| IGF-1 sR | 733 | 1110 | 1243 | 1107 | 1329 | 1253 |
| P-Cadherin/Fc | 762 | 815 | 1020 | 669 | 666 | 656 |
| EPO R/Fc | 666 | 1175 | 994 | 911 | 920 | 851 |
| DLL4 | 23398 | 29772 | 19481 | 5472 | 1541 | 1212 |
| Blank | 427 | 529 | 502 | 479 | 449 | 513 |

TABLE 64

Binding affinity of Fab VH1-46__IGHD6-6*01>1__IGHJ1*01__S104F & L6__IGKJ1*01

| Fab[nM] | 1000 | 200 | 40 | 8 | 1.6 | 0.32 |
|---|---|---|---|---|---|---|
| ErbB2/Fc | 7472 | 5434 | 3428 | 1775 | 1008 | 611 |
| EGF R/Fc | 3575 | 2921 | 2297 | 1473 | 987 | 709 |
| HGF R/Fc | 3314 | 2836 | 2110 | 1619 | 861 | 710 |
| Notch-1/Fc | 9798 | 6377 | 3990 | 2003 | 1114 | 684 |
| CD44/FC | 5105 | 4071 | 2711 | 1523 | 1016 | 679 |
| IGF-1 sR | 3074 | 2778 | 2141 | 1517 | 966 | 630 |
| P-Cadherin/Fc | 5955 | 6263 | 5103 | 2634 | 1369 | 750 |
| EPO R/Fc | 5162 | 4593 | 3233 | 2040 | 1132 | 673 |
| DLL4 | 35253 | 58743 | 62035 | 44781 | 5920 | 916 |
| Blank | 2186 | 1787 | 1442 | 1117 | 713 | 518 |

TABLE 65

Binding affinity of Fab VH1-46__IGHD6-6*01__IGHJ1*01__S104A & L6__IGKJ1*01

| Fab[nM] | 1000 | 200 | 40 | 8 | 1.6 | 0.32 |
|---|---|---|---|---|---|---|
| ErbB2/Fc | 7419 | 4038 | 2231 | 1902 | 1168 | 766 |
| EGF R/Fc | 3481 | 2951 | 1843 | 1298 | 862 | 660 |
| HGF R/Fc | 3531 | 2443 | 1545 | 1305 | 830 | 574 |
| Notch-1/Fc | 8058 | 5705 | 3479 | 2196 | 1166 | 739 |
| CD44/FC | 4734 | 3189 | 2677 | 1487 | 1017 | 684 |
| IGF-1 sR | 3348 | 2603 | 1897 | 1287 | 815 | 611 |
| P-Cadherin/Fc | 5632 | 3993 | 2602 | 1916 | 1139 | 649 |
| EPO R/Fc | 8292 | 3997 | 3510 | 1982 | 1117 | 739 |
| DLL4 | 14331 | 14838 | 13637 | 9329 | 2130 | 646 |
| Blank | 2142 | 1659 | 1229 | 1188 | 648 | 428 |

TABLE 66

Binding affinity of Fab VH5-51__IGHD5-18*01>3__IGHJ4*01__G104T & V3-4__IGLJ1*01

| Fab[nM] | 1000 | 10 |
|---|---|---|
| ErbB2/Fc | 3532 | 1517 |
| EGF R/Fc | 3937 | 1188 |
| HGF R/Fc | 3769 | 1392 |
| Notch-1/Fc | 3342 | 933 |
| CD44/Fc | 3378 | 841 |
| IGF-1 sR | 3992 | 1118 |
| P-Cadherin/Fc | 3426 | 705 |
| EPO R/Fc | 3376 | 910 |
| DLL4 | 29776 | 5229 |
| Blank | 1742 | 427 |

TABLE 67

Binding affinity of Fab VH1-46__IGHD6-6*01__IGHJ1*01__S103P & L6__IGKJ1*01

| Fab[nM] | 1000 | 10 |
|---|---|---|
| ErbB2/Fc | 1276 | 847 |
| EGF R/Fc | 1909 | 773 |
| HGF R/Fc | 1359 | 859 |
| Notch-1/Fc | 1210 | 792 |
| CD44/Fc | 1220 | 746 |
| IGF-1 sR | 1336 | 814 |
| P-Cadherin/Fc | 1376 | 846 |
| EPO R/Fc | 1511 | 802 |
| DLL4 | 29752 | 55127 |
| Blank | 760 | 550 |

TABLE 68

Binding affinity of Fab VH1-46__IGHD6-6*01__IGHJ1*01__S102A & L6__IGKJ1*01

| Fab[nM] | 1000 | 10 |
|---|---|---|
| ErbB2/Fc | 946 | 670 |
| EGF R/Fc | 1601 | 677 |
| HGF R/Fc | 1658 | 698 |
| Notch-1/Fc | 1253 | 647 |
| CD44/Fc | 1087 | 681 |
| IGF-1 sR | 1167 | 657 |
| P-Cadherin/Fc | 1502 | 691 |
| EPO R/Fc | 1320 | 761 |
| DLL4 | 22225 | 38724 |
| Blank | 1121 | 418 |

TABLE 69

Binding affinity of Fab VH1-46__IGHD6-6*01__IGHJ1*01__S102A__S103P__S104F & L6__IGKJ1*01

| Fab[nM] | 1000 | 10 |
|---|---|---|
| ErbB2/Fc | 1292 | 842 |
| EGF R/Fc | 2434 | 809 |
| HGF R/Fc | 1581 | 691 |
| Notch-1/Fc | 1620 | 1144 |
| CD44/FC | 1314 | 887 |
| IGF-1 sR | 1175 | 720 |
| P-Cadherin/Fc | 2499 | 894 |
| EPO R/Fc | 1656 | 1109 |
| DLL4 | 73307 | 345030 |
| Blank | 731 | 680 |

TABLE 70

Binding affinity of Fab VH5-51__IGHD5-18*01>3__IGHJ4*01__G100K__G104T & V34__IGLJ1*01

| Fab[nM] | 500 | 25 | 1.25 | 0.0625 |
|---|---|---|---|---|
| ErbB2/Fc | 957 | 927 | 695 | 692 |
| EGF R/Fc | 1106 | 821 | 729 | 736 |
| HGF R/Fc | 1299 | 805 | 774 | 643 |
| Notch-1/Fc | 703 | 440 | 312 | 439 |
| CD44/Fc | 923 | 570 | 444 | 394 |
| IGF-1 sR | 1114 | 780 | 674 | 537 |
| P-Cadherin/Fc | 815 | 269 | 374 | 331 |
| EPO R/Fc | 828 | 597 | 448 | 332 |
| DLL4 | 25941 | 77931 | 38837 | 1014 |
| Blank | 480 | 206 | 256 | 239 |

TABLE 71

Binding affinity of Fab VH1-46_IGHD6-6*01_IGHJ1*01_S102A_S103P_S104F_H111F & L6_IGKJ1*01

| Fab[nM] | 500 | 50 | 5 |
|---|---|---|---|
| ErbB2/Fc | 2621 | 2114 | 1377 |
| EGF R/Fc | 2514 | 2042 | 1158 |
| HGF R/Fc | 2043 | 1282 | 1016 |
| Notch-1/Fc | 4376 | 2726 | 1170 |
| CD44/Fc | 2912 | 1610 | 1132 |
| IGF-1 sR | 1872 | 1226 | 917 |
| P-Cadherin/Fc | 3665 | 2491 | 1663 |
| EPO R/Fc | 5518 | 2462 | 1835 |
| DLL4 | 29919 | 94200 | 149972 |
| Blank | 1016 | 774 | 626 |

TABLE 72

Binding affinity of Fab VH1-46_IGHD6-6*01_IGHJ1*01_S102A_S103P_S104F_H111Y & L6_IGKJ1*01

| Fab[nM] | 500 | 50 | 5 | 0.5 |
|---|---|---|---|---|
| ErbB2/Fc | 713 | 589 | 315 | 331 |
| EGF R/Fc | 898 | 523 | 311 | 273 |
| HGF R/Fc | 523 | 325 | 323 | 319 |
| Notch-1/Fc | 644 | 475 | 383 | 263 |
| CD44/Fc | 664 | 433 | 413 | 279 |
| IGF-1 sR | 592 | 460 | 320 | 164 |
| P-Cadherin/Fc | 939 | 626 | 437 | 215 |
| EPO R/Fc | 1212 | 631 | 377 | 359 |
| DLL4 | 93071 | 206919 | 84945 | 2971 |
| Blank | 410 | 433 | 367 | 365 |

TABLE 73

Binding affinity of Fab VH1-46_IGHD6-6*01_IGHJ1*01_S102A_S103P_S104Y_H111Y & L6_IGKJ1*01

| Fab[nM] | 500 | 50 | 5 | 0.5 |
|---|---|---|---|---|
| ErbB2/Fc | 596 | 470 | 2855 | 1721 |
| EGF R/Fc | 758 | 489 | 2980 | 1751 |
| HGF R/Fc | 841 | 312 | 3101 | 1688 |
| Notch-1/Fc | 689 | 389 | 3232 | 1756 |
| CD44/Fc | 604 | 345 | 2756 | 1563 |
| IGF-1 sR | 747 | 399 | 3033 | 1662 |
| P-Cadherin/Fc | 1195 | 470 | 4162 | 2628 |
| EPO R/Fc | 1273 | 533 | 3582 | 1840 |
| DLL4 | 105743 | 201050 | 73428 | 5150 |
| Blank | 436 | 329 | 2104 | 1309 |

TABLE 74

Binding affinity of Fab VH1-46_IGHD6-6*01_IGHJ1*01_S102A_S103P_S104F & L6_IGKJ1*01_S28P

| Fab[nM] | 50 | 10 | 2 | 0.4 |
|---|---|---|---|---|
| ErbB2/Fc | 384 | 136 | 176 | 275 |
| EGF R/Fc | 328 | 207 | 352 | 246 |
| HGF R/Fc | 183 | 136 | 255 | 199 |
| Notch-1/Fc | 477 | 280 | 307 | 248 |
| CD44/Fc | 340 | 212 | 266 | 257 |
| IGF-1 sR | 355 | 152 | 205 | 172 |
| P-Cadherin/Fc | 431 | 216 | 223 | 191 |
| EPO R/Fc | 527 | 392 | 251 | 147 |
| DLL4 | 37653 | 26851 | 6103 | 1140 |
| Blank | 274 | 146 | 130 | 138 |

TABLE 75

Binding affinity of Fab VH1-46_IGHD6-6*01_IGHJ1*01_S102A_S103P_S104F & L6_IGKJ1*01_S30N

| Fab[nM] | 50 | 10 | 2 | 0.4 |
|---|---|---|---|---|
| ErbB2/Fc | 395 | 274 | 138 | 203 |
| EGF R/Fc | 294 | 245 | 171 | 173 |
| HGF R/Fc | 135 | 239 | 207 | 120 |
| Notch-1/Fc | 279 | 253 | 274 | 197 |
| CD44/Fc | 271 | 286 | 209 | 176 |
| IGF-1 sR | 240 | 233 | 296 | 141 |
| P-Cadherin/Fc | 143 | 283 | 395 | 111 |
| EPO R/Fc | 500 | 420 | 294 | 224 |
| DLL4 | 37208 | 33374 | 11375 | 1039 |
| Blank | 299 | 165 | 205 | 179 |

TABLE 76

Binding affinity of Fab VH1-46_IGHD6-6*01_IGHJ1*01_S102A_S103P_S104F & L6_IGKJ1*01_S31K

| Fab[nM] | 50 | 10 | 2 | 0.4 |
|---|---|---|---|---|
| ErbB2/Fc | 397 | 303 | 337 | 159 |
| EGF R/Fc | 350 | 297 | 197 | 175 |
| HGF R/Fc | 257 | 271 | 183 | 119 |
| Notch-1/Fc | 355 | 388 | 202 | 197 |
| CD44/Fc | 262 | 352 | 146 | 190 |
| IGF-1 sR | 257 | 214 | 222 | 65 |
| P-Cadherin/Fc | 411 | 240 | 351 | 151 |
| EPO R/Fc | 574 | 392 | 326 | 217 |
| DLL4 | 35274 | 29781 | 10534 | 1259 |
| Blank | 183 | 267 | 197 | 255 |

Summary

Table 77, below, summarizes the results of the MSD assay. Table 77 lists the recombinant human target/protein antigen(s) and the Fabs, as designated by their respective heavy and light chains (including SEQ ID NOS). As is indicated in Table 77, below, several Fabs were identified that bind to multiple targets. For example, Fab VH1-46_IGHD2-15*01_IGHJ2*01 & L12_IGKJ1*01 binds to EGF R, Epo R and DLL4 while Fab VH1-46_IGHD3-10*01_IGHJ4*01 & L12_IGKJ1*01 binds to Notch-1, P-cadherin and DLL4. Table 77 below also lists the 15 additional modified Fabs (set forth in rows 22-36) that bind to DLL4.

TABLE 77

Selected Fabs and their targets

| Fab No. | rHuman Target | Heavy Chain | SEQ ID NO | Light Chain | SEQ ID NO |
|---|---|---|---|---|---|
| 1 | Epo R/Fc chimera | VH4-28_IGHD7-27*01_IGHJ1*01 | 1759 | L2_IGKJ1*01 | 1843 |
| 2 | Epo R/Fc chimera | VH4-31_IGHD7-27*01_IGHJ5*01 | 1769 | L2_IGKJ1*01 | 1843 |

TABLE 77-continued

Selected Fabs and their targets

| Fab No. | rHuman Target | Heavy Chain | SEQ ID NO | Light Chain | SEQ ID NO |
|---|---|---|---|---|---|
| 3 | ErbB2/Fc chimera | VH2-5__IGHD7-27*01__IGHJ2*01 | 1559 | L2_IGKJ1*01 | 1843 |
| 4 | Epo R/Fc chimera | VH1-46__IGHD7-27*01__IGHJ2*01 | 1514 | A27_IGKJ1*01 | 1833 |
| 5 | ErbB2/Fc chimera | VH1-69__IGHD1-1*01__IGHJ6*01 | 1522 | A17_IGKJ1*01 | 1828 |
| 6 | Epo R/Fc chimera and EGF R/Fc chimera | VH1-46__IGHD2-15*01__IGHJ2*01 | 1508 | L2_IGKJ1*01 | 1843 |
| 7 | EGF R/Fc chimera, Notch-1/Fc chimera, P-cadherin/Fc chimera, Epo R/Fc chimera and DLL4 | VH1-46__IGHD6-13*01__IGHJ4*01 | 1512 | L2_IGKJ1*01 | 1843 |
| 8 | DLL4 | VH4-34__IGHD7-27*01__IGHJ4*01 | 1779 | L5_IGKJ1*01 | 1849 |
| 9 | Notch-1/Fc chimera, P-cadherin/Fc chimera, Epo R/Fc chimera and DLL4 | VH1-46__IGHD6-13*01__IGHJ4*01 | 1512 | A27_IGKJ1*01 | 1833 |
| 10 | P-cadherin/Fc chimera | VH1-46__IGHD7-27*01__IGHJ2*01 | 1514 | L6_IGKJ1*01 | 1850 |
| 11 | DLL4 | VH1-3__IGHD4-23*01__IGHJ4*01 | 1494 | L12_IGKJ1*01 | 1841 |
| 12 | EGF R/Fc chimera, Epo R/Fc chimera and DLL4 | VH1-46__IGHD2-15*01__IGHJ2*01 | 1508 | L12_IGKJ1*01 | 1841 |
| 13 | Notch-1/Fc chimera, P-cadherin/Fc chimera and DLL4 | VH1-46__IGHD3-10*01__IGHJ4*01 | 1509 | L12_IGKJ1*01 | 1841 |
| 14 | DLL4 | VH1-8__IGHD2-2*01__IGHJ6*01 | 1537 | L12_IGKJ1*01 | 1841 |
| 15 | Epo R/Fc chimera | VH1-46__IGHD3-10*01__IGHJ4*01 | 1509 | O1_IGKJ1*01 | 1853 |
| 16 | Epo R/Fc chimera and DLL4 | VH1-46__IGHD6-13*01__IGHJ4*01 | 1512 | O1_IGKJ1*01 | 1853 |
| 17 | DLL4 | VH4-34__IGHD7-27*01__IGHJ4*01 | 1779 | V1-4_IGLJ4*01 | 1864 |
| 18 | DLL4 | VH4-31__IGHD2-15*01__IGHJ2*01 | 1761 | V1-4_IGLJ4*01 | 1864 |
| 19 | DLL4 | VH4-34__IGHD7-27*01__IGHJ4*01 | 1779 | V4-6_IGLJ4*01 | 1886 |
| 20 | P-cadherin/Fc chimera and Epo R/Fc chimera | VH3-23__IGHD3-10*01>3__IGHJ6*01 | 3359 | O12_IGKJ1*01 | 1854 |
| 21 | P-cadherin/Fc chimera | VH3-23__IGHD3-10*01>1'__IGHJ3*01 | 3071 | O12_IGKJ1*01 | 1854 |
| 22 | DLL4 | VH5-51__IGHD5-18*01>3__IGHJ4*01_G100K | 3720 | V3-4_IGLJ1*01 | 1881 |
| 23 | DLL4 | VH5-51__IGHD5-18*01>3__IGHJ4*01_G100R | 3721 | V3-4_IGLJ1*01 | 1881 |
| 24 | DLL4 | VH1-46__IGHD6-6*01>1__IGHJ1*01__S104F | 3722 | L6_IGKJ1*01 | 1850 |
| 25 | DLL4 | VH1-46__IGHD6-6*01__IGHJ1*01__S104A | 3723 | L6_IGKJ1*01 | 1850 |
| 26 | DLL4 | VH5-51__IGHD5-18*01>3__IGHJ4*01_G104T | 3724 | V3-4_IGLJ1*01 | 1881 |
| 27 | DLL4 | VH1-46__IGHD6-6*01__IGHJ1*01__S103P | 3725 | L6_IGKJ1*01 | 1850 |
| 28 | DLL4 | VH1-46__IGHD6-6*01__IGHJ1*01__S102A | 3726 | L6_IGKJ1*01 | 1850 |
| 29 | DLL4 | VH1-46__IGHD6-6*01__IGHJ1*01__S102A_S103P_S104F | 3727 | L6_IGKJ1*01 | 1850 |
| 30 | DLL4 | VH5-51__IGHD5-18*01>3__IGHJ4*01_G100K_G104T | 3728 | V3-4_IGLJ1*01 | 1881 |
| 31 | DLL4 | VH1-46__IGHD6-6*01__IGHJ1*01__S102A_S103P_S104F_H111F | 3729 | L6_IGKJ1*01 | 1850 |
| 32 | DLL4 | VH1-46__IGHD6-6*01__IGHJ1*01__S102A_S103P_S104F_H111Y | 3730 | L6_IGKJ1*01 | 1850 |
| 33 | DLL4 | VH1-46__IGHD6-6*01__IGHJ1*01__S102A_S103P_S104Y_H111Y | 3731 | L6_IGKJ1*01 | 1850 |
| 34 | DLL4 | VH1-46__IGHD6-6*01__IGHJ1*01__S102A_S103P_S104F | 3727 | L6_IGKJ1*01_S28P | 3732 |
| 35 | DLL4 | VH1-46__IGHD6-6*01__IGHJ1*01__S102A_S103P_S104F | 3727 | L6_IGKJ1*01_S30N | 3733 |
| 36 | DLL4 | VH1-46__IGHD6-6*01__IGHJ1*01__S102A_S103P_S104F | 3727 | L6_IGKJ1*01_S31K | 3734 |

Example 16

Surface Plasmon Resonance

In this example, the binding affinities of selected Fabs (see Tables 78-79) to recombinant human DLL4 (R&D Systems) were analyzed using Surface Plasmon Resonance (SPR) (Biosensor Tools, Salt Lake City, Utah). The Fabs (see Table 78) include germline antibodies identified in the initial ECL screen as binding to DLL4 (as shown in Example 13) and modified Fabs that contain one or more mutations in the heavy or light chain as compared to the initially identified anti-DLL4 Fabs.

The results are shown in Table 79 below. Table 79 lists Fab (by Fab No.), the $k_a$ ($M^{-1}s^{-1}$), the $k_d$ ($s^{-1}$), and the $K_D$ (nM) and the standard deviation (in parentheses). The results indicate that the Fabs have binding affinity for DLL4 ranging from 48.5 nM to 38 uM. Germline Fab VH5-51_IGHD5-18*01>3_IGHJ4*01 & V3-4_IGLJ1*01 has an average $K_D$ of 4.8 uM while variant Fab VH5-51_IGHD5-18*01>3_IGHJ4*01_G100K_G104T & V3-4_IGLJ1*01 has an improved $K_D$ of 355 nM. Germline Fab VH1-46_IGHD6-6*01_IGHJ1*01 & L6_IGKJ1*01 binds DLL4 with an average $K_D$ of 730 nM while the variant Fabs (rows 5-6 and 8-10 of Tables 78 and 79 below) bind DLL4 with improved $K_D$s ranging from 70.6 nM to 388 nM. Germline Fab VH6-1_IGHD3-3*01_IGHJ4*01 & V4-3_IGLJ4*01 has an average binding affinity of 38 uM while germline Fab VH1-46_IGHD3-10*01_IGHJ4*01 & L12_IGKJ1*01 has an average $K_D$ of 500 nM.

Example 17

Inhibition of DLL4-Notch Interaction

In this example, four Fabs previously identified as binding to DLL4 were functionally screened for their ability to block the binding of Notch-Fc to DLL4.

In this ELISA assay, recombinant human DLL4 bound to the plate followed by the addition of both the Fab and Notch-Fc. An anti-human FC-HRP conjugated antibody was used as a detection molecule therefore if Notch-Fc binds to DLL4, a strong signal will be observed at A450. Alternatively, if the Fab is capable of blocking the bind of Notch-Fc to DLL4, no signal should be observed. The Fabs that were assayed included Fab VH1-46_IGHD6-6*01_IGHJ1*01_S102A_S103P_S104F & L6_IGKJ1*01, Fab VH1-46_IGHD6-6*01_IGHJ1*01_S102A_S103P_S104F_H111F & L6_IGKJ1*01, Fab VH5-51_IGHD5-18*01>3_IGHJ4*01_G100K_G104T & V3-4_IGLJ1*01 and Fab VH1-46_IGHD3-10*01_IGHJ4*01 & L12_IGKJ1*01.

In short, Maxisorp Nunc 96-well plates were coated with 0.5 μg/ml recombinant human DLL4 extracellular domain (R&D Systems) for at least 2 hours. The wells were washed and then blocked with 4% BSA. Following blocking, Fabs VH1-46_IGHD6-6*01_IGHJ1*01_S102A_S103P_S104F & L6_IGKJ1*01, VH1-46_IGHD6-6*01_IGHJ1*01_S102A_S103P_S104F_H111F & L6_IGKJ1*01, VH5-51_IGHD5-18*01>3_IGHJ4*01_G100K_G104T & V3-4_IGLJ1*01 and VH1-46_IGHD3-10*01_IGHJ4*01 & L12_IGKJ1*01 at concentrations from 0.004 and 5 μM were added together with recombinant human Fc-Notch extracellular domain (R&D Systems) at a concentration of 10 nM. After incubation for one to two hours, the wells were washed and Notch binding was measure using a mouse anti-human FC-HRP conjugated antibody (Southern Biotech) at an 1:1000 dilution. HRP activity was detected using TMB substrate (Pierce) followed by acid neutralization. The A450 was measured on a SpectraMax Plus 384.

Results show that the addition of Fabs VH1-46_IGHD6-6*01_IGHJ1*01 _S102A_S103P_S104F & L6_IGKJ1*01, VH1-46_IGHD6-6*01_IGHJ1*01 _S102A_S103P_S104F_H111F & L6_IGKJ1*01 or VH5-51_IGHD5-18*01>3_IGHJ4*01_G100K_G104T & V3-4_IGL1*01 resulted in a decreased signal therefore indicating their ability to block the binding of Notch-Fc to DLL4. The addition of Fab VH1-46_IGHD3-10*01_IGHJ4*01 & L12_IGKJ1*01did not result an any loss of activity, indicating that Fab VH1-46_IGHD3-10*01_IGHJ4*01 & L12_IGKJ1*01does not block the Notch-DLL4 interaction.

TABLE 78

DLL4 Fabs for Surface Plasmon Resonance

| Fab No | Heavy Chain | Light Chain |
|---|---|---|
| 1 | VH5-51_IGHD5-18*01>3_IGHJ4*01 | V3-4_IGLJ1*01 |
| 2 | VH1-46_IGHD6-6*01_IGHJ1*01 | L6_IGKJ1*01 |
| 3 | VH6-1_IGHD3-3*01_IGHJ4*01 | V4-3_IGLJ4*01 |
| 4 | VH1-46_IGHD3-10*01_IGHJ4*01 | L12_IGKJ1*01 |
| 5 | VH1-46_IGHD6-6*01>1_IGHJ1*01_S104F | L6_IGKJ1*01 |
| 6 | VH1-46_IGHD6-6*01_IGHJ1*01_S102A_S103P_S104F | L6_IGKJ1*01 |
| 7 | VH5-51_IGHD5-18*01>3_IGHJ4*01_G100K_G104T | V3-4_IGLJ1*01 |
| 8 | VH1-46_IGHD6-6*01_IGHJ1*01_S102A_S103P_S104F_H111F | L6_IGKJ1*01 |
| 9 | VH1-46_IGHD6-6*01_IGHJ1*01_S102A_S103P_S104F_H111Y | L6_IGKJ1*01 |
| 10 | VH1-46_IGHD6-6*01_IGHJ1*01_S102A_S103P_S104F | L6_IGKJ1*01_S31K |

TABLE 79

Binding affinity of DLL4 Fabs

| Fab No | $k_a$ ($M^{-1}s^{-1}$) | $k_d$ ($s^{-1}$) | $K_D$ (nM) |
|---|---|---|---|
| 1 | n/a | n/a | 4800(200) |
| 2 | 1.63(3)e5 | 0.101(2) | 730(130) |
| 3 | n/a | n/a | 38000(4000) |
| 4 | 5(1)e5 | 0.29(2) | 500(100) |
| 5 | 5.0(8)e5 | 0.19(1) | 380(60) |
| 6 | 4.05(5)e5 | 0.0492(4) | 122(1) |
| 7 | 0.645(0.92)e5 | 0.023 | 355(7) |
| 8 | 4.25(4)e5 | 0.0300(2) | 70.6(7) |
| 9 | 3.40(3)e5 | 0.0317(2) | 93.1(9) |
| 10 | 3.50(5)e5 | 0.0392(4) | 112(2) |

This result also indicates that Fabs VH1-46_IGHD6-6*01_IGHJ1*01_S102A_S103P_S104F & L6_IGKJ1*01, VH1-46_IGHD6-6*01_IGHJ1*01_S102A_S103P_S104F_H111F & L6_IGKJ1*01 or VH5-51_IGHD5-18*01>3_IGHJ4*01_G100K_G104T & V3-4_IGLJ1*01 bind different epitopes of DLL4 than Fab VH1-46_IGHD3-10*01IGHJ4*01 & L12_IGKJ1*01.

Example 18

EpoR Cell Based Assay for Receptor Stimulation

In this example, Fabs were analyzed for their ability to stimulate the erythropoietin receptor using a cell based assay. The cell lines used included Ba/F3 cells transfected with the human erythropoietin receptor (EpoR) and parental Ba/F3 cells cells lacking EpoR. The parental Ba/F3 cells do not respond to receptor agonist and both cell lines required IL-3 for growth.

In short, Ba/F3 cells (with and without EpoR) were propagated in RPMI 1640 media with 10% FBS, antibiotics, and 5 ng/L recombinant mouse IL-3, washed into equivalent media lacking IL-3 and plated into 96 well plates at 5000 cells/well in 50 µl. Following plating, cells were treated with 10 µl of Fabs, agonist control EMP16 (TYSCHFGPLTWVCKPQ, SEQ ID NO:3735), or vehicle, and grown for 4 days at 37° C. in humid 5% $CO_2$ atmosphere. To measure cell viability and proliferation, a resazurin-based viability assay reagent was added to test wells for 24 hours. Reduction of the reagent by metabolically active cells produced the readily-quantifiable fluorescent molecule resorufin. Average fluorescence for each treatment was divided by the average fluorescence of vehicle controls to give fold proliferation.

The results show that 40 nM Fab VH1-46_IGHD2-15*01_IGHJ2*01 & L2_IGKJ1*01 showed receptor dependent proliferation, while 54 nM Fab VH1-46_IGHD6-13*01_IGHJ4*01 & O1_IGKJ1*01 showed little proliferation over vehicle in both receptor-expressing cells and parental cells. The known receptor agonist peptide EMP16 (TYSCHFGPLTWVCKPQ, SEQ ID NO:3735), added at a concentration of 2.5 µM, showed strong cell proliferation.

Example 19

Inhibition of DLL4/Jag1

In this example, a cellular assay is described in which activation of the Notch pathway prevents C2C12 myoblast cell differentiation (see e.g., Jarriault et al., 1998 Molecular and Cellular Biology, 18:7423-7431). In order to activate the Notch pathway, Notch ligands, such as DLL4 or Jag1, must be expressed as full-length proteins on the cell surface. To achieve this Notch activation, non-adherent cells naturally or ectopically expressing Notch ligands DLL4 or Jag1 are co-cultured with C2C12 cells and selected Fabs. Functional inhibition of DLL4 or Jag1 is assessed by the ability of the Fab to promote differentiation, indicating Notch pathway inactivation. The differentiation into tube-like structures is easily discernible morphologically and additionally can be detected with an antibody against troponin t (Sigma-Aldrich).

In short, C2C12 mouse myoblast cells are cultured in the presence and absence of Jag1-expressing IM9 cells (a human lymphoblast cell line) and Fabs. The cells are plated onto glass coverslips in 12 well dishes in DMEM containing 10% FBS (fetal bovine serum). The next day attached C2C12 cells are transferred into DMEM containing 1% FBS to induce differentiation. Following incubation, the cells are visualized to observe whether differentiation into myotubes occurred. Low serum conditions will induce the differentiation of myotubes while Jag1-expressing IM9 cells maintain C2C12 cells in an undifferentiated state in low serum conditions.

Example 20

Inhibition of p-Cadherin

In this example, a cellular assay is described in which the ability of an antibody to inhibit P-cadherin is observed by the failure of cells to "clump". P-cadherin is involved in cell-to-cell adhesion and therefore inhibition of P-cadherin leads to cell scattering.

In short, A431 epidermoid carcinoma cells are plated at 10,000 cells/well (96-well in DMEM with 10% FBS into 96-well dishes. The next day, Fab is added to wells at 100 mg/ml. Function blocking p-cadherin antibody (Abcam) is used as a positive control and DMEM with 10% FBS alone is used as a negative control (see e.g. Shimoyama, Y. et al., 1989 Cancer Research, 49:2128-2133). After 3.5 hours cells are examined for "scattering" and photographed. Cells that are incubated with media only exhibit significant "clumping" while cells that are incubated with an anti-P-cadherin Fab or antibody are scattered.

Since modifications will be apparent to those of skill in this art, it is intended that this invention be limited only by the scope of the appended claims.

---

SEQUENCE LISTING (3755 sequences)

SEQ ID NO: 1 - DNA, 5476 bp, Artificial Sequence
  Plasmid A (heavy chain with Flag-H6 tag)
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaaaaagaatatcgcatttcttcttgcatctatgttcgttttttcaattgctacgaacgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 2 - DNA, 5491 bp, Artificial Sequence
  Plasmid D (heavy chain with Flag-LPETG-H6 tag)
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaaaaagaatatcgcatttcttcttgcatctatgttcgttttttcaattgctacgaacgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcttccggaaaccggtcatcatcaccatcaccattaattaattaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 3 - DNA, 4980 bp, Artificial Sequence
  Plasmid C (for kappa light chain)
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaagaaaaacatcgcctttctgcttgcatcgatgttcgtgttttcgatcgcgaccaacgccatggcggaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacaaggcctattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtctaagaaaccattattat

SEQ ID NO: 4 - DNA, 4986 bp, Artificial Sequence
  Plasmid E (for lambda light chain)
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctagataattaattaggaggaatttaaaatgaagaaaaacatcgcctttctgcttgcatcgatgttcgtgttttcgatcgcgaccaacgccatggcgcagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacggcatccctgatcgcttctcaggctccagctctggggctgagcgctacctcaccatctccagcctccagtctgaggatgaggctgactattactgtcagacctggggcactggcattcattatgtcttcggaactgggaccaaggtcaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacaaggcctattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtctaagaaaccattattat

SEQ ID NO: 5 - protein, 19 aa, E. coli
  DsbA leader sequence
MKKIWLALAGLVLAFSASA

SEQ ID NO: 6 - protein, 23 aa, E. coli
  SfmC leader sequence
MMTKIKLLMLIIFYLIISASAHA

SEQ ID NO: 7 - protein, 21 aa, E. coli
  TolB leader sequence
MKQALRVAFGFLILWASVLHA

SEQ ID NO: 8 - protein, 18 aa, E. coli
  TorT leader sequence
MRVLLFLLLSLFMLPAFS

SEQ ID NO: 9 - protein, 23 aa, E. coli
  STII leader sequence
MKKNIAFLLASMFVFSIATNAYA

SEQ ID NO: 10 - DNA, 296 bp, Homo sapiens
  IGHV1-18*01
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagaga

SEQ ID NO: 11 - DNA, 276 bp, Homo sapiens
  IGHV1-18*02
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctaagatctgacgacacggcc

SEQ ID NO: 12 - DNA, 296 bp, Homo sapiens
  IGHV1-2*01
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggacggatcaaccctaacagtggtggcacaaactatgcacagaagtttcagggcagggtcaccagtaccagggacacgtccatcagcacagcctacatggagctgagcaggctgagatctgacgacacggtcgtgtattactgtgcgagaga

SEQ ID NO: 13 - DNA, 296 bp, Homo sapiens
  IGHV1-2*02
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagaga

SEQ ID NO: 14 - DNA, 296 bp, Homo sapiens
  IGHV1-2*03
  misc_feature 113: N = a or g or c or t
caggtgcagctggtgcagtctggggctgaggtgaagaagcttggggcctcagtgaaggtctcctgcaaggcttctggatacaccttcaccggctactatatgcactgggtgcnacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagaga

SEQ ID NO: 15 - DNA, 294 bp, Homo sapiens
  IGHV1-2*04
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggctgggtcaccatgaccagggacacgtccatcagcacagcctacatggagctgagcaggctgagatctgacgacacggccgtgtattactgtgcgaga

SEQ ID NO: 16 - DNA, 296 bp, Homo sapiens
  IGHV1-24*01
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacaga

SEQ ID NO: 17 - DNA, 296 bp, Homo sapiens
  IGHV1-3*01
caggtccagcttgtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagaga

SEQ ID NO: 18 - DNA, 296 bp, Homo sapiens
  IGHV1-3*02
caggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagaga

SEQ ID NO: 19 - DNA, 294 bp, Homo sapiens
  IGHV1-45*01
cagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattactagggacaggtctatgagcacagcctacatggagctgagcagcctgagatctgaggacacagccatgtattactgtgcaaga

SEQ ID NO: 20 - DNA, 294 bp, Homo sapiens
  IGHV1-45*02
cagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaaga

SEQ ID NO: 21 - DNA, 260 bp, Homo sapiens
  IGHV1-45*03
agaagactgggtcctcagtgaaggtttcctgcaaggcttccggatacaccttcacctaccgctacctgcactgggtgcgacaggcccccagacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaaga

SEQ ID NO: 22 - DNA, 296 bp, Homo sapiens
  IGHV1-46*01
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaga

SEQ ID NO: 23 - DNA, 296 bp, Homo sapiens
  IGHV1-46*02
caggtgcagctggtgcagtctggggctgaggtgaagaagcctggggcctcagtgaaggtttcctgcaaggcatctggatacaccttcaacagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaga

SEQ ID NO: 24 - DNA, 296 bp, Homo sapiens
  IGHV1-46*03
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgctagaga

SEQ ID NO: 25 - DNA, 296 bp, Homo sapiens
  IGHV1-58*01
caaatgcagctggtgcagtctgggcctgaggtgaagaagcctgggacctcagtgaaggtctcctgcaaggcttctggattcacctttactagctctgctgtgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcaga

SEQ ID NO: 26 - DNA, 296 bp, Homo sapiens
  IGHV1-58*02
caaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcaga

SEQ ID NO: 27 - DNA, 296 bp, Homo sapiens
  IGHV1-69*01
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 28 - DNA, 294 bp, Homo sapiens
  IGHV1-69*02
caggtccagctggtgcaatctggggctgaggtgaagaagcctgggtcctcggtgaaggtctcctgcaaggcttctggaggcaccttcagcagctatactatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgaga

SEQ ID NO: 29 - DNA, 275 bp, Homo sapiens
  IGHV1-69*03
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgatgacacggc

SEQ ID NO: 30 - DNA, 296 bp, Homo sapiens
  IGHV1-69*04
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgagaga

SEQ ID NO: 31 - DNA, 294 bp, Homo sapiens
  IGHV1-69*05
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccacggacgaatccacgagcacagcctacatggagctgagcagcctgagatctgaggacacggccgtgtattactgtgcgaga

SEQ ID NO: 32 - DNA, 296 bp, Homo sapiens
  IGHV1-69*06
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagaga

SEQ ID NO: 33 - DNA, 233 bp, Homo sapiens
  IGHV1-69*07
agaagcctgggtcctcggtgaaggtctcctgcaaggcttctggaggcaccttcagcagctatgctatcagctgggtgcgacaggcccctggacaagggcttgagtggatgggaaggatcatccctatctttggtacagcaaactacgcacagaagttccagggcagagtcacgattaccgcggacgaatccacgagcacagcctacatggagctgagcagcctgagatctgag

SEQ ID NO: 34 - DNA, 296 bp, Homo sapiens
  IGHV1-69*08
caggtccagctggtgcaatctggggctgaggtgaagaagcctgggtcctcggtgaaggtctcctgcaaggcttctggaggcaccttcagcagctatactatcagctgggtgcgacaggcccctggacaagggcttgagtggatgggaaggatcatccctatccttggtacagcaaactacgcacagaagttccagggcagagtcacgattaccgcggacaaatccacgagcacagcctacatggagctgagcagcctgagatctgaggacacggccgtgtattactgtgcgagaga

SEQ ID NO: 35 - DNA, 296 bp, Homo sapiens
  IGHV1-69*09
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgagaga

SEQ ID NO: 36 - DNA, 296 bp, Homo sapiens
  IGHV1-69*10
caggtccagctggtgcagtctggggctgaggtgaagaagcctgggtcctcagtgaaggtctcctgcaaggcttctggaggcaccttcagcagctatgctatcagctgggtgcgacaggcccctggacaagggcttgagtggatgggagggatcatccctatccttggtatagcaaactacgcacagaagttccagggcagagtcacgattaccgcggacaaatccacgagcacagcctacatggagctgagcagcctgagatctgaggacacggccgtgtattactgtgcgagaga

SEQ ID NO: 37 - DNA, 296 bp, Homo sapiens
  IGHV1-69*11
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 38 - DNA, 296 bp, Homo sapiens
  IGHV1-69*12
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 39 - DNA, 296 bp, Homo sapiens
  IGHV1-69*13
caggtccagctggtgcagtctggggctgaggtgaagaagcctgggtcctcagtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 40 - DNA, 296 bp, Homo sapiens
  IGHV1-8*01
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagagg

SEQ ID NO: 41 - DNA, 260 bp, Homo sapiens
  IGHV1-c*01
ggaagtctggggcctcagtgaaagtctcctgtagtttttctgggtttaccatcaccagctacggtatacattgggtgcaacagtcccctggacaagggcttgagtggatgggatggatcaaccctggcaatggtagcccaagctatgccaagaagtttcagggcagattcaccatgaccagggacatgtccacaaccacagcctacacagacctgagcagcctgacatctgaggacatggctgtgtattactatgcaaga

SEQ ID NO: 42 - DNA, 294 bp, Homo sapiens
  IGHV1-f*01
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcaaca

SEQ ID NO: 43 - DNA, 233 bp, Homo sapiens
  IGHV1-f*02
agaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatatgcagagaagttccagggcagagtcaccataaccgcggacacgtctacagacacagcctacatggagctgagcagcctgagatctgag

SEQ ID NO: 44 - DNA, 301 bp, Homo sapiens
  IGHV2-26*01
caggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatac

SEQ ID NO: 45 - DNA, 302 bp, Homo sapiens
  IGHV2-5*01
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacc

SEQ ID NO: 46 - DNA, 124 bp, Homo sapiens
  IGHV2-5*02
actagtggagtgggtgtgggctggatccgtcagcccccaggaaaggccctggagtggcttgcactcatttattgggatgatgataagcgctacagcccatctctgaagagcaggctcaccatca

SEQ ID NO: 47 - DNA, 210 bp, Homo sapiens
  IGHV2-5*03
gctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccattaccaaggacacctccaaaaaccaggt

SEQ ID NO: 48 - DNA, 297 bp, Homo sapiens
  IGHV2-5*04
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacaggcacatattactgtgtacgg

SEQ ID NO: 49 - DNA, 301 bp, Homo sapiens
  IGHV2-5*05
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacggcccatctctgaagagcaggctcaccatcaccaaggacacctccaaaaaccaggtggtccttacaatgaccaacatggaccctgtggacacagccacatattactgtgcacacagac

SEQ ID NO: 50 - DNA, 300 bp, Homo sapiens
  IGHV2-5*06
cagatcaccttgaaggagtctggtcctacgctggtaaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacggcccatctctgaagagcaggctcaccatcaccaaggacacctccaaaaaccaggtggtccttacaatgaccaacatggaccctgtggacacagccacatattactgtgcacacaga

SEQ ID NO: 51 - DNA, 294 bp, Homo sapiens
  IGHV2-5*07
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacaggcacatattactgtgta

SEQ ID NO: 52 - DNA, 301 bp, Homo sapiens
  IGHV2-5*08
caggtcaccttgaaggagtctggtcctgcgctggtgaaacccacacagaccctcacactgacctgcaccttctctgggttctcactcagcactagtggaatgcgtgtgagctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagac

SEQ ID NO: 53 - DNA, 301 bp, Homo sapiens
  IGHV2-5*09
caggtcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacggcccatctctgaagagcaggctcaccatcaccaaggacacctccaaaaaccaggtggtccttacaatgaccaacatggaccctgtggacacagccacatattactgtgcacacagac

SEQ ID NO: 54 - DNA, 297 bp, Homo sapiens
  IGHV2-5*10
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacgg

SEQ ID NO: 55 - DNA, 301 bp, Homo sapiens
  IGHV2-70*01
caggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattactgtgcacggatac

SEQ ID NO: 56 - DNA, 290 bp, Homo sapiens
  IGHV2-70*02
caggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacggccgtgtattactg

SEQ ID NO: 57 - DNA, 290 bp, Homo sapiens
  IGHV2-70*03
caggtcaccttgaaggagtctggtcctgcgctggtgaaacccacacagaccctcacactgacctgcaccttctctgggttctcactcagcactagtggaatgcgtgtgagctggatccgtcagcccccagggaaggccctggagtggcttgcacgcattgattgggatgatgataaattctacagcacatctctgaagaccaggctcaccatctccaaggacacctccaaaaaccaggtggtccttacaatgaccaacatggaccctgtggacacggccgtgtattactg

SEQ ID NO: 58 - DNA, 288 bp, Homo sapiens
  IGHV2-70*04
caggtcaccttgaaggagtctggtcctgcgctggtgaaacccacacagaccctcacactgacctgcaccttctctgggttctcactcagcactagtggaatgcgtgtgagctggatccgtcagcccccagggaaggccctggagtggcttgcacgcattgattgggatgatgataaattctacagcacatctctgaagaccaggctcaccatctccaaggacacctccaaaaaccaggtggtccttacaatgaccaacatggaccctgtggacacagccacgtattac

SEQ ID NO: 59 - DNA, 237 bp, Homo sapiens
  IGHV2-70*05
tgcgctggtgaaacccacacagaccctcacactgacctgcaccttctctgggttctcactcagcactagtggaatgcgtgcgagctggatccgtcagcccccagggaaggccctggagtggcttgcacgcattgattgggatgatgataaattctacagcacatctctgaagaccaggctcaccatctccaaggacacctccaaaaaccaggtggtccttacaatgaccaacatgga

SEQ ID NO: 60 - DNA, 290 bp, Homo sapiens
  IGHV2-70*06
caggtcaccttgaaggagtctggtcctgcgctggtgaaacccacacagaccctcacactgacctgcaccttctctgggttctcactcagcactagtggaatgcgtgtgagctggatccgtcagcccccagggaaggccctggagtggcttgcacgcattgattgggatgatgataaattctacagcacatccctgaagaccaggctcaccatctccaaggacacctccaaaaaccaggtggtccttacaatgaccaacatggaccctgtggacacggccgtgtattactg

SEQ ID NO: 61 - DNA, 290 bp, Homo sapiens
  IGHV2-70*07
caggtcaccttgagggagtctggtcctgcgctggtgaaacccacacagaccctcacactgacctgcaccttctctgggttctcactcagcactagtggaatgtgtgtgagctggatccgtcagcccccggggaaggccctggagtggcttgcactcattgattgggatgatgataaatactacagcacatctctgaagaccaggctcaccatctccaaggacacctccaaaaaccaggtggtccttacaatgaccaacatggaccctgtggacacggccgtgtattactg

SEQ ID NO: 62 - DNA, 290 bp, Homo sapiens
  IGHV2-70*08
caggtcaccttgagggagtctggtcctgcgctggtgaaacccacacagaccctcacactgacctgcgccttctctgggttctcactcagcactagtggaatgtgtgtgagctggatccgtcagcccccagggaaggccctggagtggcttgcacgcattgattgggatgatgataaatactacagcacatctctgaagaccaggctcaccatctccaaggacacctccaaaaaccaggtggtccttacaatgaccaacatggaccctgtggacacggccgtgtattactg

SEQ ID NO: 63 - DNA, 297 bp, Homo sapiens
  IGHV2-70*09
cagatcaccttgaaggagtctggtcctacgctggtgaaacccacacagaccctcacgctgacccgcaccttctctgggttctcactcagcactagtggaatgtgtgtgagctggatccgtcagcccccagggaaggccctggagtggcttgcactcattgattgggatgatgataaatactacagcacatctctgaacaccaggctcaccatctccaaggacacctccaaaaaccaggtggtccttacaatgaccaacatggaccctgtggacacaggcacatattactgtgtacgg

SEQ ID NO: 64 - DNA, 301 bp, Homo sapiens
  IGHV2-70*10
caggtcaccttgaaggagtctggtcctgcgctggtgaaacccacacagaccctcacactgacctgcaccttctctgggttctcactcagcactagtggaatgcgtgtgagctggatccgtcagcccccagggaaggccctggagtggattgcacgcattgattgggatgatgataaatactacagcacatctctgaagaccaggctcaccatctccaaggacacctccaaaaaccaggtggtccttacaatgaccaacatggaccctgtggacacagccacgtattactgtgcacggatac

SEQ ID NO: 65 - DNA, 301 bp, Homo sapiens
  IGHV2-70*10
cgggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcacgcattgattgggatgatgataaatactacagcacatctctgaagaccaggctcaccatctccaaggacacctccaaaaaccaggtggtccttacaatgaccaacatggaccctgtggacacagccacgtattactgtgcacggatac

SEQ ID NO: 66 - DNA, 301 bp, Homo sapiens
  IGHV2-70*12
cagatcaccttgaaggagtctggtcctacgctggtgaaacccacacagaccctcacgctgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacatattactgtgcacacagac

SEQ ID NO: 67 - DNA, 301 bp, Homo sapiens
  IGHV2-70*13
caggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatac

SEQ ID NO: 68 - DNA, 296 bp, Homo sapiens
  IGHV3-11*01
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagaga

SEQ ID NO: 69 - DNA, 294 bp, Homo sapiens
  IGHV3-11*03
caggtgcagctgttggagtctgggggaggcttggtcaagcctggagggtccctgagactctcctgtgcagcctctggattcaccttcagtgactactacatgagctggatccgccaggctccagggaaggggctggagtgggtttcatacattagtagtagtagtagttacacaaactacgcagactctgtgaagggccgattcaccatctccagagacaacgccaagaactcactgtatctgcaaatgaacagcctgagagccgaggacacggccgtgtattactgtgcgaga

SEQ ID NO: 70 - DNA, 293 bp, Homo sapiens
  IGHV3-13*01
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagaga

SEQ ID NO: 71 - DNA, 293 bp, Homo sapiens
  IGHV3-13*02
gaggtgcatctggtggagtctgggggaggcttggtacagcctgggggggccctgagactctcctgtgcagcctctggattcaccttcagtaactacgacatgcactgggtccgccaagctacaggaaaaggtctggagtgggtctcagccaatggtactgctggtgacacatactatccaggctccgtgaaggggcgattcaccatctccagagaaaatgccaagaactccttgtatcttcaaatgaacagcctgagagccggggacacggctgtgtattactgtgcaagaga

SEQ ID NO: 72 - DNA, 291 bp, Homo sapiens
  IGHV3-13*02
gaggtgcagctggtggagtctgggggaggcttggtacagcctggggggtccctgagactctcctgtgcagcctgtggattcaccttcagtagctacgacatgcactgggtccgccaagctacaggaaaaggtctggagtgggtctcagctattggtactgctggtgacacatactatccaggctccgtgaagggccaattcaccatctccagagaaaatgccaagaactccttgtatcttcaaatgaacagcctgagagccggggacacggctgtgtattactgtgcaaga

SEQ ID NO: 73 - DNA, 302 bp, Homo sapiens
  IGHV3-15*01
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacaga

SEQ ID NO: 74 - DNA, 302 bp, Homo sapiens
  IGHV3-15*02
gaggtgcagctggtggagtctgggggagccttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacaga

SEQ ID NO: 75 - DNA, 302 bp, Homo sapiens
  IGHV3-15*03
gaggtgcagctggtggagtctgccggagccttggtacagcctggggggtcccttagactctcctgtgcagcctctggattcacttgcagtaacgcctggatgagctgggtccgccaggctccagggaaggggctggagtgggttggccgtattaaaagcaaagctaatggtgggacaacagactacgctgcacctgtgaaaggcagattcaccatctcaagagttgattcaaaaaacacgctgtatctgcaaatgaacagcctgaaaaccgaggacacagccgtgtattactgtaccacaga

SEQ ID NO: 76 - DNA, 302 bp, Homo sapiens
  IGHV3-15*04
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattgaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacaga

SEQ ID NO: 77 - DNA, 302 bp, Homo sapiens
  IGHV3-15*05
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagtctgaaaaccgaggacacagccgtgtattactgtaccacaga

SEQ ID NO: 78 - DNA, 302 bp, Homo sapiens
  IGHV3-15*06
gaggtgcagctggtggagtctgggggaggcttggtaaagcctggggggtcccttagactctcctgtgcagcctctggattcactttcagtaacgcctggatgagctgggtccgccaggctccagggaaggggctggagtgggtcggccgtattaaaagcaaaactgatggtgggacaacaaactacgctgcacccgtgaaaggcagattcaccatctcaagagatgattcaaaaaacacgctgtatctgcaaatgaacagcctgaaaaccgaggacacagccgtgtattactgtaccacaga

SEQ ID NO: 79 - DNA, 302 bp, Homo sapiens
  IGHV3-15*07
gaggtgcagctggtggagtctgggggaggcttggtaaagcctggggggtcccttagactctcctgtgcagcctctggtttcactttcagtaacgcctggatgaactgggtccgccaggctccagggaaggggctggagtgggtcggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacaga

SEQ ID NO: 80 - DNA, 302 bp, Homo sapiens
  IGHV3-15*08
gaggtgcagctggtggagtctgcgggaggcttggtacagcctggggggtcccttagactctcctgtgcagcctctggattcacttgcagtaacgcctggatgagctgggtccgccaggctccagggaaggggctggagtgggttggctgtattaaaagcaaagctaatggtgggacaacagactacgctgcacctgtgaaaggcagattcaccatctcaagagatgattcaaaaaacacgctgtatctgcaaatgatcagcctgaaaaccgaggacacggccgtgtattactgtaccacagg

SEQ ID NO: 81 - DNA, 296 bp, Homo sapiens
  IGHV3-16*01
gaggtacaactggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaa

SEQ ID NO: 82 - DNA, 296 bp, Homo sapiens
  IGHV3-16*02
gaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaa

SEQ ID NO: 83 - DNA, 296 bp, Homo sapiens
  IGHV3-20*01
gaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagaga

SEQ ID NO: 84 - DNA, 296 bp, Homo sapiens
  IGHV3-21*01
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagaga

SEQ ID NO: 85 - DNA, 296 bp, Homo sapiens
  IGHV3-21*02
gaggtgcaactggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagaga

SEQ ID NO: 86 - DNA, 296 bp, Homo sapiens
  IGHV3-23*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaga

SEQ ID NO: 87 - DNA, 296 bp, Homo sapiens
  IGHV3-23*02
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacggagactccgtgaagggccggttcaccatctcaagagacaattccaagaacacgctgtatctgcaaatgaacagcctgagagccgaggacacggccgtatattactgtgcgaaaga

SEQ ID NO: 88 - DNA, 294 bp, Homo sapiens
  IGHV3-23*03
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagttatttatagcggtggtagtagcacatactatgcagactccgtgaagggccggttcaccatctccagagataattccaagaacacgctgtatctgcaaatgaacagcctgagagccgaggacacggccgtatattactgtgcgaaa

SEQ ID NO: 89 - DNA, 296 bp, Homo sapiens
  IGHV3-23*04
gaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaga

SEQ ID NO: 90 - DNA, 294 bp, Homo sapiens
  IGHV3-23*05
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctatttatagcagtggtagtagcacatactatgcagactccgtgaagggccggttcaccatctccagagacaattccaagaacacgctgtatctgcaaatgaacagcctgagagccgaggacacggccgtatattactgtgcgaaa

SEQ ID NO: 91 - DNA, 296 bp, Homo sapiens
  IGHV3-30*01
caggtgcagctggtggagtctgggggaggcgtggtccagcctgggaggtccctgagactctcctgtgcagcctctggattcaccttcagtagctatgctatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaga

SEQ ID NO: 92 - DNA, 296 bp, Homo sapiens
  IGHV3-30*02
caggtgcagctggtggagtctgggggaggcgtggtccagcctggggggtccctgagactctcctgtgcagcgtctggattcaccttcagtagctatggcatgcactgggtccgccaggctccaggcaaggggctggagtgggtggcatttatacggtatgatggaagtaataaatactatgcagactccgtgaagggccgattcaccatctccagagacaattccaagaacacgctgtatctgcaaatgaacagcctgagagctgaggacacggctgtgtattactgtgcgaaaga

SEQ ID NO: 93 - DNA, 296 bp, Homo sapiens
  IGHV3-30*03
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagaga

SEQ ID NO: 94 - DNA, 296 bp, Homo sapiens
  IGHV3-30*04
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaga

SEQ ID NO: 95 - DNA, 296 bp, Homo sapiens
  IGHV3-30*05
caggtgcagctggtggagtctgggggaggcgtggtccagcctgggaggtccctgagactctcctgtgcagcctctggattcaccttcagtagctatggcatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgaacagcctgagagctgagggcacggctgtgtattactgtgcgagaga

SEQ ID NO: 96 - DNA, 296 bp, Homo sapiens
  IGHV3-30*06
caggtgcagctggtggagtctgggggaggcgtggtccagcctgggaggtccctgagactctcctgtgcagcgtctggattcaccttcagtagctatggcatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaga

SEQ ID NO: 97 - DNA, 296 bp, Homo sapiens
  IGHV3-30*07
caggtgcagctggtggagtctgggggaggcgtggtccagcctgggaggtccctgagactctcctgtgcagcctctggattcaccttcagtagctatgctatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgaacagcctgagagccgaggacacggctgtgtattactgtgcgagaga

SEQ ID NO: 98 - DNA, 294 bp, Homo sapiens
  IGHV3-30*08
caggtgcagctggtggactctgggggaggcgtggtccagcctgggaggtccctgagactctcctgtgcagcctctgcattcaccttcagtagctatgctatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgaga

SEQ ID NO: 99 - DNA, 296 bp, Homo sapiens
  IGHV3-30*09
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcgccatctccagagacaattccaagaacacgctgtatctgcaaatgaacagcctgagagctgaggacacggctgtgtattactgtgcgagaga

SEQ ID NO: 100 - DNA, 296 bp, Homo sapiens
  IGHV3-30*10
caggtgcagctggtggagtctgggggaggcgtggtccagcctgggaggtccctgagactctcctgtgcagcctctggattcaccttcagtagctatgctatgcactgggtccgccaggctccaggcaaggggctagagtgggtggcagttatatcatatgatggaagtaataaatactacacagactccgtgaagggccgattcaccatctccagagacaattccaagaacacgctgtatctgcaaatgaacagcctgagagctgaggacacggctgtgtattactgtgcgagaga

SEQ ID NO: 101 - DNA, 296 bp, Homo sapiens
  IGHV3-30*11
caggtgcagctggtggagtctgggggaggcgtggtccagcctgggaggtccctgagactctcctgtgcagcgtctggattcaccttcagtagctatgctatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaga

SEQ ID NO: 102 - DNA, 296 bp, Homo sapiens
  IGHV3-30*12
caggtgcagctggtggagtctggggggggcgtggtccagcctgggaggtccctgagactctcctgtgcagcgtctggattcaccttcagtagctatggcatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgaacagcctgagagccgaggacacggctgtgtattactgtgcgagaga

SEQ ID NO: 103 - DNA, 296 bp, Homo sapiens
  IGHV3-30*13
caggtgcagctggtggagtctgggggaggcgtggtccagcctgggaggtccctgagactctcctgtgcagcctctggattcaccttcagtagctatggcatgcactgggtccgccaggctccaggcaaggggctagagtgggtggcagttatatcatatgatggaagtaataaatactacgcagactccgtgaagggccgattcaccatctccagagacaattccaagaacaggctgtatctgcaaatgaacagcctgagagctgaggacacggctgtgtattactgtgcgagaga

SEQ ID NO: 104 - DNA, 296 bp, Homo sapiens
  IGHV3-30*14
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatcttcaaatgaacagcctgagagctgaggacacggctgtgtattactgtgcgagaga

SEQ ID NO: 105 - DNA, 296 bp, Homo sapiens
  IGHV3-30*15
caggtgcagctggtggagtctgggggaggcgtggtccagcctgggaggtccctgagactctcctgtgcagcctctggattcaccttcagtagctatgctatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgagcagcctgagagctgaggacacggctgtgtattactgtgcgagaga

SEQ ID NO: 106 - DNA, 296 bp, Homo sapiens
  IGHV3-30*16
caggtgcagctggtggagtctgggggaggcgtggtccagcctgggaggtccctgagactctcctgtgcagcctctggattcaccttcagtagctatgctatgcactgggtccgccaggccccaggcaaggggctagagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaga

SEQ ID NO: 107 - DNA, 296 bp, Homo sapiens
  IGHV3-30*17
caggtgcagctggtggagtctgggggaggcgtggtccagcctgggaggtccctgagactctcctgtgcagcctctggattcaccttcagtagctatgctatgcactgggtccgccaggctccgggcaaggggctagagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaga

SEQ ID NO: 108 - DNA, 296 bp, Homo sapiens
  IGHV3-30*18
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaaga

SEQ ID NO: 109 - DNA, 296 bp, Homo sapiens
  IGHV3-30*19
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaga

SEQ ID NO: 110 - DNA, 294 bp, Homo sapiens
  IGHV3-30-3*01
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgaga

SEQ ID NO: 111 - DNA, 296 bp, Homo sapiens
  IGHV3-30-3*02
caggtgcagctggtggagtctgggggaggcgtggtccagcctgggaggtccctgagactctcctgtgcagcgtctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgaaaga

SEQ ID NO: 112 - DNA, 296 bp, Homo sapiens
  IGHV3-33*01
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaga

SEQ ID NO: 113 - DNA, 296 bp, Homo sapiens
  IGHV3-33*02
caggtacagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgcgaagggccgattcaccatctccagagacaattccacgaacacgctgtttctgcaaatgaacagcctgagagccgaggacacggctgtgtattactgtgcgagaga

SEQ ID NO: 114 - DNA, 296 bp, Homo sapiens
  IGHV3-33*03
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaactccaagaacacgctgtatctgcaaatgaacagcctgagagccgaggacacggctgtgtattactgtgcgaaaga

SEQ ID NO: 115 - DNA, 296 bp, Homo sapiens
  IGHV3-33*04
caggtgcagctggtggagtctgggggaggcgtggtccagcctgggaggtccctgagactctcctgtgcagcgtctggattcaccttcagtagctatggcatgcactgggtccgccaggctccaggcaaggggctagagtgggtggcagttatatggtatgacggaagtaataaatactatgcagactccgtgaagggccgattcaccatctccagagacaattccaagaacacgctgtatctgcaaatgaacagcctgagagccgaggacacggctgtgtattactgtgcgagaga

SEQ ID NO: 116 - DNA, 296 bp, Homo sapiens
  IGHV3-33*05
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagccgaggacacggctgtgtattactgtgcgagaga

SEQ ID NO: 117 - DNA, 296 bp, Homo sapiens
  IGHV3-35*01
gaggtgcagctggtggagtctgggggaggcttggtacagcctgggggatccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaa

SEQ ID NO: 118 - DNA, 292 bp, Homo sapiens
  IGHV3-38*01
gaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgcgtattactgtgccagatata

SEQ ID NO: 119 - DNA, 292 bp, Homo sapiens
  IGHV3-38*02
gaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatata

SEQ ID NO: 120 - DNA, 298 bp, Homo sapiens
  IGHV3-43*01
gaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagata

SEQ ID NO: 121 - DNA, 294 bp, Homo sapiens
  IGHV3-43*02
gaagtgcagctggtggagtctgggggaggcgtggtacagcctggggggtccctgagactctcctgtgcagcctctggattcacctttgatgattatgccatgcactgggtccgtcaagctccagggaagggtctggagtgggtctctcttattagtggggatggtggtagcacatactatgcagactctgtgaagggccgattcaccatctccagagacaacagcaaaaactccctgtatctgcaaatgaacagtctgagaactgaggacaccgccttgtattactgtgcaaaa

SEQ ID NO: 122 - DNA, 296 bp, Homo sapiens
  IGHV3-48*01
gaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagccgaggacacggctgtgtattactgtgcgagaga

SEQ ID NO: 123 - DNA, 296 bp, Homo sapiens
  IGHV3-48*02
gaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgcgagaga

SEQ ID NO: 124 - DNA, 294 bp, Homo sapiens
  IGHV3-48*03
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcgaga

SEQ ID NO: 125 - DNA, 302 bp, Homo sapiens
  IGHV3-49*01
gaggtgcagctggtggagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacaccgcgtctgtgaaaggcagattcaccatctcaagagatggttccaaaagcatcgcctatctgcaaatgaacagcctgaaaaccgaggacacagccgtgtattactgtactagaga

SEQ ID NO: 126 - DNA, 302 bp, Homo sapiens
  IGHV3-49*02
gaggtgcagctggtggagtctgggggaggcttggtacagccagggccgtccctgagactctcctgtacagcttctggattcacctttgggtattatcctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaga

SEQ ID NO: 127 - DNA, 302 bp, Homo sapiens
  IGHV3-49*03
gaggtgcagctggtggagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaga

SEQ ID NO: 128 - DNA, 302 bp, Homo sapiens
  IGHV3-49*04
gaggtgcagctggtggagtctgggggaggcttggtacagccagggcggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaga

SEQ ID NO: 129 - DNA, 302 bp, Homo sapiens
  IGHV3-49*05
gaggtgcagctggtggagtctgggggaggcttggtaaagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaga

SEQ ID NO: 130 - DNA, 293 bp, Homo sapiens
  IGHV3-53*01
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagaga

SEQ ID NO: 131 - DNA, 291 bp, Homo sapiens
  IGHV3-53*02
gaggtgcagctggtggagactggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgaga

SEQ ID NO: 132 - DNA, 293 bp, Homo sapiens
  IGHV3-53*03
gaggtgcagctggtggagtctggaggaggcttgatccagcctggggggtccctgagactctcctgtgcagcctctgggttcaccgtcagtagcaactacatgagctgggtccgccagcctccagggaaggggctggagtgggtctcagttatttatagcggtggtagcacatactacgcagactctgtgaagggccgattcaccatctccagagacaattccaagaacacgctgtatcttcaaatgaacagcctgagagccgaggacacggccgtgtattactgtgctaggga

SEQ ID NO: 133 - DNA, 296 bp, Homo sapiens
  IGHV3-64*01
gaggtgcagctggtggagtctgggggaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaga

SEQ ID NO: 134 - DNA, 296 bp, Homo sapiens
  IGHV3-64*02
gaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagaga

SEQ ID NO: 135 - DNA, 296 bp, Homo sapiens
  IGHV3-64*03
gaggtgcagctggtggagtctgggggaggcttggtccagcctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatgtccaaatgagcagtctgagagctgaggacacggctgtgtattactgtgtgaaaga

SEQ ID NO: 136 - DNA, 296 bp, Homo sapiens
  IGHV3-64*04
caggtgcagctggtggagtctgggggaggcttggtccagcctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatctgcaaatgaacagcctgagagctgaggacacggctgtgtattactgtgcgagaga

SEQ ID NO: 137 - DNA, 296 bp, Homo sapiens
  IGHV3-64*05
gaggtgcagctggtggagtctgggggaggcttggtccagcctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatgttcaaatgagcagtctgagagctgaggacacggctgtgtattactgtgtgaaaga

SEQ ID NO: 138 - DNA, 293 bp, Homo sapiens
  IGHV3-66*01
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggcagattcaccatctccagagacaattccaagaacacgctgtatcttcaaatgaacagcctgagagccgaggacacggctgtgtattactgtgcgagaga

SEQ ID NO: 139 - DNA, 291 bp, Homo sapiens
  IGHV3-66*02
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagctgaggacacggctgtgtattactgtgcgaga

SEQ ID NO: 140 - DNA, 293 bp, Homo sapiens
  IGHV3-66*03
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagctgtggtagcacatactacgcagactccgtgaagggccgattcaccatctccagagacaattccaagaacacgctgtatcttcaaatgaacagcctgagagctgaggacacggctgtgtattactgtgcgagaga

SEQ ID NO: 141 - DNA, 293 bp, Homo sapiens
  IGHV3-66*04
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggcagattcaccatctccagagacaattccaagaacacgctgtatcttcaaatgaacagcctgagagccgaggacacggctgtgtattactgtgcgagaca

SEQ ID NO: 142 - DNA, 296 bp, Homo sapiens
  IGHV3-7*01
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagaga

SEQ ID NO: 143 - DNA, 294 bp, Homo sapiens
  IGHV3-7*02
gaggtgcagctggtggagtctgggggaggcttggtccagcctggggggtccctgagactctcctgtgcagcctctggattcacctttagtagctattggatgagctgggtccgccaggctccagggaaagggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgaga

SEQ ID NO: 144 - DNA, 302 bp, Homo sapiens
  IGHV3-72*01
gaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagaga

SEQ ID NO: 145 - DNA, 165 bp, Homo sapiens
  IGHV3-72*02
accttcagtgaccactacatggactgggtccgccaggctccagggaaggggctggagtgggttggccgtactagaaacaaagctaacagctacaccacagaatacgccgcgtctgtgaaaggcagattcaccatctcaagagatgattcaaagaactcactgtat

SEQ ID NO: 146 - DNA, 300 bp, Homo sapiens
  IGHV3-73*01
gaggtgcagctggtggagtctgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactaga

SEQ ID NO: 147 - DNA, 302 bp, Homo sapiens
  IGHV3-73*02
gaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagaca

SEQ ID NO: 148 - DNA, 296 bp, Homo sapiens
  IGHV3-74*01
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagaga

SEQ ID NO: 149 - DNA, 294 bp, Homo sapiens
  IGHV3-74*02
gaggtgcagctggtggagtctgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaaga

SEQ ID NO: 150 - DNA, 296 bp, Homo sapiens
  IGHV3-74*03
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaacgtacgcggactccgtgaagggccgattcaccatctccagagacaacgccaagaacacgctgtatctgcaaatgaacagtctgagagccgaggacacggctgtgtattactgtgcaagaga

SEQ ID NO: 151 - DNA, 298 bp, Homo sapiens
  IGHV3-9*01
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagata

SEQ ID NO: 152 - DNA, 288 bp, Homo sapiens
  IGHV3-d*01
gaggtgcagctggtggagtctcggggagtcttggtacagcctggggggtccctgagactctcctgtgcagcctctggattcaccgtcagtagcaatgagatgagctgggtccgccaggctccagggaagggtctggagtgggtctcatccattagtggtggtagcacatactacgcagactccaggaagggcagattcaccatctccagagacaattccaagaacacgctgcatcttcaaatgaacagcctgagagctgaggacacggctgtgtattactgtaagaaa

SEQ ID NO: 153 - DNA, 296 bp, Homo sapiens
  IGHV4-28*01
caggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaa

SEQ ID NO: 154 - DNA, 296 bp, Homo sapiens
  IGHV4-28*02
caggtgcagctgcaggagtcgggcccaggactggtgaagccttcacagaccctgtccctcacctgcgctgtctctggttactccatcagcagtagtaactggtggggctggatccggcagcccccagggaagggactggagtggattgggtacatctattatagtgggagcatctactacaacccgtccctcaagagtcgagtcaccatgtcagtagacacgtccaagaaccagttctccctgaagctgagctctgtgaccgccgtggacacggccgtgtattactgtgcgagaaa

SEQ ID NO: 155 - DNA, 296 bp, Homo sapiens
  IGHV4-28*03
caggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaga

SEQ ID NO: 156 - DNA, 294 bp, Homo sapiens
  IGHV4-28*04
caggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacaccggcgtgtattactgtgcgaga

SEQ ID NO: 157 - DNA, 287 bp, Homo sapiens
  IGHV4-28*05
caggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcatctactacaacccgtccctcaagagtcgagtcaccatgtcagtagacacgtccaagaaccagttctccctgaagctgagctctgtgaccgccgtggacacggccgtgtattactg

SEQ ID NO: 158 - DNA, 299 bp, Homo sapiens
  IGHV4-30-2*01
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgccgcggacacggccgtgtattactgtgccagaga

SEQ ID NO: 159 - DNA, 294 bp, Homo sapiens
  IGHV4-30-2*02
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgctgcggacacggccgtgtattactgtgcg

SEQ ID NO: 160 - DNA, 299 bp, Homo sapiens
  IGHV4-30-2*03
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggagtatctattatagtgggagcacctactacaacccgtccctcaagagtcgagtcaccatatccgtagacacgtccaagaaccagttctccctgaagctgagctctgtgaccgctgcagacacggctgtgtattactgtgcgagaca

SEQ ID NO: 161 - DNA, 227 bp, Homo sapiens
  IGHV4-30-2*04
tctggtggctccatcagcagtggtggttactcctggagctggatccggcagccaccagggaagggcctggagtggattgggtacatctatcatagtgggagcacctactacaacccgtccctcaagagtcgagtcaccatatcagtagacacgtccaagaaccagttctccctgaagctgagctctgtgaccgccgcagacacggccgtgtattactgtgcgagaga

SEQ ID NO: 162 - DNA, 299 bp, Homo sapiens
  IGHV4-30-4*01
caggtgcagctgcaggagtcgggcccaggactggtgaagccttcacagaccctgtccctcacctgcactgtctctggtggctccatcagcagtggtgattactactggagttggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgccgcagacacggccgtgtattactgtgccagaga

SEQ ID NO: 163 - DNA, 299 bp, Homo sapiens
  IGHV4-30-4*02
caggtgcagctgcaggagtcgggcccaggactggtgaagccttcggacaccctgtccctcacctgcactgtctctggtggctccatcagcagtggtgattactactggagttggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgcagcagacacggccgtgtattactgtgccagaga

SEQ ID NO: 164 - DNA, 290 bp, Homo sapiens
  IGHV4-30-4*03
caggtgcagctgcaggagtcgggcccaggactggtgaagccttcacagaccctgtccctcacctgcactgtctctggtggctccatcagcagtggtgattactactggagttggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgccgcggacacggccgtgtattactg

SEQ ID NO: 165 - DNA, 290 bp, Homo sapiens
  IGHV4-30-4*04
caggtgcagctgcaggactcgggcccaggactggtgaagccttcacagaccctgtccctcacctgcactgtctctggtggctccatcagcagtggtgattactactggagttggatccgccagcccccagggaagggcctggagtggattgggtacttctattacagtgggagcacctactacaacccgtccctcaagagtcgagttaccatatcagtagacacgtccaagaaccagttctccctgaagctgagctctgtgactgccgcagacacggccgtgtattactg

SEQ ID NO: 166 - DNA, 228 bp, Homo sapiens
  IGHV4-30-4*05
  misc_feature 54: N = a or g or c or t
ctctggtggctccatcagcagtggtgattactactggagttggatccgccagcncccagggaagggcctggagtggattgggtacatctattacagtgggagcacctactacaacccgtccctcaagagtcgagtcaccatatcagtagacacgtccaagaaccagttctccctgaagctgagctctgtgactgccgcagacacggccgtgtattactgtgccagaga

SEQ ID NO: 167 - DNA, 227 bp, Homo sapiens
  IGHV4-30-4*06
tctggtggctccatcagcagtggtgattactactggagttggatccgccagcacccagggaagggcctggagtggattgggtacatctattacagtgggagcacctactacaacccgtccctcaagagtcgagttaccatatcagtagacacgtccaagaaccagttctccctgaagctgagctctgtgactgccgcagacacggccgtgtattactgtgccagaga

SEQ ID NO: 168 - DNA, 299 bp, Homo sapiens
  IGHV4-31*01
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtctagttaccatatcagtagacacgtctaagaaccagttctccctgaagctgagctctgtgactgccgcggacacggccgtgtattactgtgcgagaga

SEQ ID NO: 169 - DNA, 299 bp, Homo sapiens
  IGHV4-31*02
caggtgcagctgcaggagtcgggcccaggactggtgaagccttcacagaccctgtccctcacctgtactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagaga

SEQ ID NO: 170 - DNA, 299 bp, Homo sapiens
  IGHV4-31*03
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagaga

SEQ ID NO: 171 - DNA, 294 bp, Homo sapiens
  IGHV4-31*04
caggtgcggctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcg

SEQ ID NO: 172 - DNA, 291 bp, Homo sapiens
  IGHV4-31*05
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgaccgcggacgcggccgtgtattactgtgcg

SEQ ID NO: 173 - DNA, 290 bp, Homo sapiens
  IGHV4-31*06
caggtgcagctgcaggagtcgggcccaggactggtgaagccttcacagaccctgtccctcacctgcactgtctctggtggctccatcagcagtggtagttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactg

SEQ ID NO: 174 - DNA, 290 bp, Homo sapiens
  IGHV4-31*07
caggtgcagctgcaggagtcgggcccaggactggtgaagccttcacagaccctgtccctcacctgcactgtctctggtggatccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactg

SEQ ID NO: 175 - DNA, 290 bp, Homo sapiens
  IGHV4-31*08
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatccgtagacacgtccaagaaccagttctccctgaagctgagctctgtgactgccgcggacacggccgtgtattactg

SEQ ID NO: 176 - DNA, 290 bp, Homo sapiens
  IGHV4-31*09
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacaagtccaagaaccagttctccctgaagctgagctctgtgaccgccgcggacacggccgtgtattactg

SEQ ID NO: 177 - DNA, 299 bp, Homo sapiens
  IGHV4-31*10
caggtgcagctgcaggagtcgggcccaggactgttgaagccttcacagaccctgtccctcacctgcactgtctctggtggctccatcagcagtggtggttactactggagctggatccgccagcacccagggaagggcctggagtggattgggtgcatctattacagtgggagcacctactacaacccgtccctcaagagtcgagttaccatatcagtagacccgtccaagaaccagttctccctgaagccgagctctgtgactgccgcggacacggccgtggattactgtgcgagaga

SEQ ID NO: 178 - DNA, 293 bp, Homo sapiens
  IGHV4-34*01
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagg

SEQ ID NO: 179 - DNA, 293 bp, Homo sapiens
  IGHV4-34*02
caggtgcagctacaacagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagg

SEQ ID NO: 180 - DNA, 284 bp, Homo sapiens
  IGHV4-34*03
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactg

SEQ ID NO: 181 - DNA, 293 bp, Homo sapiens
  IGHV4-34*04
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaacaacaacccgtccctcaagagtcgagccaccatatcagtagacacgtccaagaaccagttctccctgaagctgagctctgtgaccgccgcggacacggctgtgtattactgtgcgagagg

SEQ ID NO: 182 - DNA, 293 bp, Homo sapiens
  IGHV4-34*05
caggtgcagctacagcagtggggcgcaggactgttgaagccttcggagaccctgtccctcacctgcgctgtctatggtgggtccttcagtggttactactggtgctggatccgccagcccctagggaaggggctggagtggattggggaaatcaatcatagtggaagcaccaacaacaacccgtccctcaagagtcgagccaccatatcagtagacacgtccaagaaccagttctccctgaagctgagctctgtgaccgccgcggacacggctgtgtattactgtgcgagagg

SEQ ID NO: 183 - DNA, 284 bp, Homo sapiens
  IGHV4-34*06
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgggctctgtgaccgccgcggacacggccgtgtattactg

SEQ ID NO: 184 - DNA, 284 bp, Homo sapiens
  IGHV4-34*07
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaaccatagtggaagcaccaactacaacccgtccctcaagagtcgagtcaccatatcagtagacacgtccaagaaccagttctccctgaagctgagctctgtgaccgccgcggacacggccgtgtattactg

SEQ ID NO: 185 - DNA, 288 bp, Homo sapiens
  IGHV4-34*08
caggtgcagctacagcagtggggcgcaggactgttgaagccttcggagaccctgtccctcacctgcgctgtctatggtgggaccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcg

SEQ ID NO: 186 - DNA, 293 bp, Homo sapiens
  IGHV4-34*09
caggtgcagctgcaggagtcgggcccaggactggtgaagccttcacagaccctgtccctcacctgcgctgtctatggtgggtccttcagtggttactactggagctggatccgccagcccccagggaagggactggagtggattggggaaatcaatcatagtggaagcaccaactacaacccgtccctcaagagtcgagttaccatatcagtagacacgtctaagaaccagttctccctgaagctgagctctgtgactgccgcggacacggccgtgtattactgtgcgagaga

SEQ ID NO: 187 - DNA, 293 bp, Homo sapiens
  IGHV4-34*10
caggtgcagctgcaggagtcgggcccaggactggtgaagccttcggagaccctgtccctcacctgcgctgtctatggtgggtccttcagtggttactactggagctggatccgccagcccccagggaagggactggagtggattggggaaatcaatcatagtggaagcaccaactacaacccgtccctcaagagtcgaatcaccatgtcagtagacacgtccaagaaccagttctacctgaagctgagctctgtgaccgccgcggacacggccgtgtattactgtgcgagata

SEQ ID NO: 188 - DNA, 293 bp, Homo sapiens
  IGHV4-34*11
caggtgcagctacagcagtggggcgcaggactgttgaagccttcggagaccctgtccctcacctgcgctgtctatggtgggtccgtcagtggttactactggagctggatccggcagcccccagggaaggggctggagtggattgggtatatctattatagtgggagcaccaacaacaacccctccctcaagagtcgagccaccatatcagtagacacgtccaagaaccagttctccctgaacctgagctctgtgaccgccgcggacacggccgtgtattgctgtgcgagaga

SEQ ID NO: 189 - DNA, 291 bp, Homo sapiens
  IGHV4-34*12
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcattcatagtggaagcaccaactacaacccgtccctcaagagtcgagtcaccatatcagtagacacgtccaagaaccagttctccctgaagctgagctctgtgaccgccgcggacacggctgtgtattactgtgcgaga

SEQ ID NO: 190 - DNA, 221 bp, Homo sapiens
  IGHV4-34*13
tatggtgggtccttcagtggttactactggagctggatccgccagcccccagggaaggggctggagtggattggggaaatcaatcatagtggaagcaccaactacaacccctccctcaagagtcgagtcaccatatcagtagacacgtccaagaaccagttctccctgaagctgagctctgtgaccgccgcggacacggctgtgtattactgtgcgagagg

SEQ ID NO: 191 - DNA, 299 bp, Homo sapiens
  IGHV4-39*01
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagaca

SEQ ID NO: 192 - DNA, 299 bp, Homo sapiens
  IGHV4-39*02
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccacttctccctgaagctgagctctgtgaccgccgcagacacggctgtgtattactgtgcgagaga

SEQ ID NO: 193 - DNA, 290 bp, Homo sapiens
  IGHV4-39*03
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggccgtgtattactg

SEQ ID NO: 194 - DNA, 196 bp, Homo sapiens
  IGHV4-39*04
gctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcggacac

SEQ ID NO: 195 - DNA, 294 bp, Homo sapiens
  IGHV4-39*05
cagctgcagctgcaggagtcgggcccaggactggtgaagccttcggagaccccgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcg

SEQ ID NO: 196 - DNA, 299 bp, Homo sapiens
  IGHV4-39*06
cggctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttccccctgaagctgagctctgtgaccgccgcggacacggccgtgtattactgtgcgagaga

SEQ ID NO: 197 - DNA, 299 bp, Homo sapiens
  IGHV4-39*07
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagaga

SEQ ID NO: 198 - DNA, 296 bp, Homo sapiens
  IGHV4-4*01
caggtgcagctgcaggagtcgggcccaggactggtgaagcctccggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattgctgtgcgagaga

SEQ ID NO: 199 - DNA, 296 bp, Homo sapiens
  IGHV4-4*02
caggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagaga

SEQ ID NO: 200 - DNA, 287 bp, Homo sapiens
  IGHV4-4*03
caggtgcagctgcaggagtcgggcccaggactggtgaagcctccggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactg

SEQ ID NO: 201 - DNA, 287 bp, Homo sapiens
  IGHV4-4*04
caggtgcagctgcaggagtcgggcccaggactggtgaagcctccggggaccctgtccctcacctgcgctatctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactg

SEQ ID NO: 202 - DNA, 287 bp, Homo sapiens
  IGHV4-4*05
caggtgcagctgcaggagttgggcccaggactggtgaagcctccggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactg

SEQ ID NO: 203 - DNA, 224 bp, Homo sapiens
  IGHV4-4*06
  misc_feature 59-61: N = a or g or c or t
tctggtggctccatcagcagtagtaactggtggagttgggtccgccagcccccagggannnggctggagtggattggggaaatctatcatagtgggagcaccaactacaacccgtccctcaagagtcgagtcaccatgtcagtagacacgtccaagaaccagttctccctgaagctgagctctgtgaccgccgcggacacggccgtgtattactgtgcgagaga

SEQ ID NO: 204 - DNA, 293 bp, Homo sapiens
  IGHV4-4*07
caggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagaga

SEQ ID NO: 205 - DNA, 293 bp, Homo sapiens
  IGHV4-59*01
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaga

SEQ ID NO: 206 - DNA, 293 bp, Homo sapiens
  IGHV4-59*02
caggtgcagctgcaggagtcgggcccaggactggtgaagccttcggagaccctgtccctcacctgcactgtctctggtggctccgtcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaga

SEQ ID NO: 207 - DNA, 288 bp, Homo sapiens
  IGHV4-59*03
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccaattctccctgaagctgagctctgtgaccgctgcggacacggccgtgtattactgtgcg

SEQ ID NO: 208 - DNA, 288 bp, Homo sapiens
  IGHV4-59*04
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattatagtgggagcacctactacaacccgtccctcaagagtcgagtcaccatgtcagtagacacgtccaagaaccagttctccctgaagctgagctctgtgaccgccgcagacacggctgtgtattactgtgcg

SEQ ID NO: 209 - DNA, 288 bp, Homo sapiens
  IGHV4-59*05
caggtgcagctgcaggagtcgggcccaggactggtgaagccttcggagaccctgtccctcacctgcactgtctctggtggctccatcagtagttactactggagctggatccggcagccgccggggaagggactggagtggattgggcgtatctattatagtgggagcacctactacaacccgtccctcaagagtcgagtcaccatatccgtagacacgtccaagaaccagttctccctgaagctgagctctgtgaccgccgcagacacggctgtgtattactgtgcg

SEQ ID NO: 210 - DNA, 288 bp, Homo sapiens
  IGHV4-59*06
caggtgcagctgcaggagtcgggcccaggactggtgaagccttcggagaccctgtccctcacctgcactgtcactggtggctccatcagtagttactactggagctggatccggcagcccgctgggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcg

SEQ ID NO: 211 - DNA, 291 bp, Homo sapiens
  IGHV4-59*07
caggtgcagctgcaggagtcgggcccaggactggtgaagccttcggacaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgaga

SEQ ID NO: 212 - DNA, 237 bp, Homo sapiens
  IGHV4-59*08
  misc_feature 36, 214: N = a or g or c or t
tccctcacctgcactgtctctggtggctccatcagnagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgccgcagacncggccgtgtattactgtgcgaga

SEQ ID NO: 213 - DNA, 221 bp, Homo sapiens
  IGHV4-59*09
  misc_feature 54, 56-58: N = a or g or c or t
tctggtggctccatcagtagttactactggagctggatccggcagcccccaggnannngactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagg

SEQ ID NO: 214 - DNA, 293 bp, Homo sapiens
  IGHV4-59*10
caggtgcagctacagcagtggggcgcaggactgttgaagccttcggagaccctgtccctcacctgcgctgtctatggtggctccatcagtagttactactggagctggatccggcagcccgccgggaaggggctggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagata

SEQ ID NO: 215 - DNA, 299 bp, Homo sapiens
  IGHV4-61*01
caggtgcagctgcaggagtcgggcccaggactggtgaagccttcggagaccctgtccctcacctgcactgtctctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaga

SEQ ID NO: 216 - DNA, 299 bp, Homo sapiens
  IGHV4-61*02
caggtgcagctgcaggagtcgggcccaggactggtgaagccttcacagaccctgtccctcacctgcactgtctctggtggctccatcagcagtggtagttactactggagctggatccggcagcccgccgggaagggactggagtggattgggcgtatctataccagtgggagcaccaactacaacccctccctcaagagtcgagtcaccatatcagtagacacgtccaagaaccagttctccctgaagctgagctctgtgaccgccgcagacacggccgtgtattactgtgcgagaga

SEQ ID NO: 217 - DNA, 299 bp, Homo sapiens
  IGHV4-61*03
caggtgcagctgcaggagtcgggcccaggactggtgaagccttcggagaccctgtccctcacctgcactgtctctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccacttctccctgaagctgagctctgtgaccgctgcggacacggccgtgtattactgtgcgagaga

SEQ ID NO: 218 - DNA, 287 bp, Homo sapiens
  IGHV4-61*04
caggtgcagctgcaggagtcgggcccaggactggtgaagccttcggagaccctgtccctcacctgcactgtctctggtggctccgtcagcagtggtagttactactggagctggatccggcagcccccagggaagggactggagtggattggatatatctattacagtgggagcaccaactacaacccctccctcaagagtcgagtcaccatatcagtagacacgtccaagaaccagttctccctgaagctgagctctgtgaccgctgacacggccgtgtattactg

SEQ ID NO: 219 - DNA, 297 bp, Homo sapiens
  IGHV4-61*05
cagctgcagctgcaggagtcgggcccaggactggtgaagccttcggagaccctgtccctcacctgcactgtctctggtggctccatcagcagtagtagttactactggggctggatccggcagcccccagggaagggactggagtggattgggtatatctattacagtgggagcaccaactacaacccctccctcaagagtcgagtcaccatatcagtagacaagtccaagaaccagttctccctgaagctgagctctgtgaccgccgcggacacggccgtgtattactgtgcgaga

SEQ ID NO: 220 - DNA, 227 bp, Homo sapiens
  IGHV4-61*06
tctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgccgcggacacggccgtgtattactgtgccagaga

SEQ ID NO: 221 - DNA, 227 bp, Homo sapiens
  IGHV4-61*07
tctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaca

SEQ ID NO: 222 - DNA, 299 bp, Homo sapiens
  IGHV4-61*08
caggtgcagctgcaggagtcgggcccaggactggtgaagccttcggagaccctgtccctcacctgcactgtctctggtggctccgtcagcagtggtggttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaga

SEQ ID NO: 223 - DNA, 294 bp, Homo sapiens
  IGHV4-b*01
caggtgcagctgcaggagtcgggcccaggactggtgaagccttcggagaccctgtccctcacctgcgctgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgaga

SEQ ID NO: 224 - DNA, 294 bp, Homo sapiens
  IGHV4-b*02
caggtgcagctgcaggagtcgggcccaggactggtgaagccttcggagaccctgtccctcacctgcactgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgaga

SEQ ID NO: 225 - DNA, 296 bp, Homo sapiens
  IGHV5-51*01
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagaca

SEQ ID NO: 226 - DNA, 296 bp, Homo sapiens
  IGHV5-51*02
gaggtgcagctggtgcagtctggagcagaggtgaaaaagcccggggagtctctgaagatctcctgtaagggttctggatacagctttaccagctactggaccggctgggtgcgccagatgcccgggaaaggcttggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagaca

SEQ ID NO: 227 - DNA, 294 bp, Homo sapiens
  IGHV5-51*03
gaggtgcagctggtgcagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgaga

SEQ ID NO: 228 - DNA, 294 bp, Homo sapiens
  IGHV5-51*04
gaggtgcagctggtgcagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagcccatcagcaccgcctacctgcagtggagcagcctgaaggcctcggacaccgccatgtattactgtgcgaga

SEQ ID NO: 229 - DNA, 245 bp, Homo sapiens
  IGHV5-51*05
aaaagcccggggagtctctgaagatctcctgtaagggttctggatacagctttaccagctactggatcggctgggtgcgccagatgcccaggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatg

SEQ ID NO: 230 - DNA, 294 bp, Homo sapiens
  IGHV5-a*01
gaagtgcagctggtgcagtctggagcagaggtgaaaaagcccggggagtctctgaggatctcctgtaagggttctggatacagctttaccagctactggatcagctgggtgcgccagatgcccgggaaaggcctggagtggatggggaggattgatcctagtgactcttataccaactacagcccgtccttccaaggccacgtcaccatctcagctgacaagtccatcagcactgcctacctgcagtggagcagcctgaaggcctcggacaccgccatgtattactgtgcgaga

SEQ ID NO: 231 - DNA, 294 bp, Homo sapiens
  IGHV5-a*03
gaagtgcagctggtgcagtccggagcagaggtgaaaaagcccggggagtctctgaggatctcctgtaagggttctggatacagctttaccagctactggatcagctgggtgcgccagatgcccgggaaaggcctggagtggatggggaggattgatcctagtgactcttataccaactacagcccgtccttccaaggccacgtcaccatctcagctgacaagtccatcagcactgcctacctgcagtggagcagcctgaaggcctcggacaccgccatgtattactgtgcgaga

SEQ ID NO: 232 - DNA, 294 bp, Homo sapiens
  IGHV5-a*04
gaagtgcagctggtgcagtctggagcagaggtgaaaaagcccggggagtctctgaggatctcctgtaagggttctggatacagctttaccagctactggatcagctgggtgcgccagatgcccgggaaaggcctggagtggatggggaggattgatcctagtgactcttataccaactacagcccgtccttccaaggccaggtcaccatctcagctgacaagtccatcagcactgcctacctgcagtggagcagcctgaaggcctcggacaccgccatgtattactgtgcgaga

SEQ ID NO: 233 - DNA, 305 bp, Homo sapiens
  IGHV6-1*01
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagaga

SEQ ID NO: 234 - DNA, 305 bp, Homo sapiens
  IGHV6-1*02
caggtacagctgcagcagtcaggtccgggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagaga

SEQ ID NO: 235 - DNA, 294 bp, Homo sapiens
  IGHV7-4-1*01
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatctgcagcctaaaggctgaggacactgccgtgtattactgtgcgaga

SEQ ID NO: 236 - DNA, 296 bp, Homo sapiens
  IGHV7-4-1*02
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcagcagcctaaaggctgaggacactgccgtgtattactgtgcgagaga

SEQ ID NO: 237 - DNA, 274 bp, Homo sapiens
  IGHV7-4-1*03
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcagcacgctaaaggctgaggacactg

SEQ ID NO: 238 - DNA, 296 bp, Homo sapiens
  IGHV7-81*01
caggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctccatggacacctctgccagcacagcatacctgcagatcagcagcctaaaggctgaggacatggccatgtattactgtgcgagata

SEQ ID NO: 239 - DNA, 17 bp, Homo sapiens
  IGHD1-1*01
ggtacaactggaacgac

SEQ ID NO: 240 - DNA, 17 bp, Homo sapiens
  IGHD1-14*01
ggtataaccggaaccac

SEQ ID NO: 241 - DNA, 17 bp, Homo sapiens
  IGHD1-20*01
ggtataactggaacgac

SEQ ID NO: 242 - DNA, 20 bp, Homo sapiens
  IGHD1-26*01
ggtatagtgggagctactac

SEQ ID NO: 243 - DNA, 17 bp, Homo sapiens
  IGHD1-7*01
ggtataactggaactac

SEQ ID NO: 244 - DNA, 31 bp, Homo sapiens
  IGHD2-15*01
aggatattgtagtggtggtagctgctactcc

SEQ ID NO: 245 - DNA, 31 bp, Homo sapiens
  IGHD2-2*01
aggatattgtagtagtaccagctgctatgcc

SEQ ID NO: 246 - DNA, 31 bp, Homo sapiens
  IGHD2-2*02
aggatattgtagtagtaccagctgctatacc

SEQ ID NO: 247 - DNA, 31 bp, Homo sapiens
  IGHD2-2*03
tggatattgtagtagtaccagctgctatgcc

SEQ ID NO: 248 - DNA, 28 bp, Homo sapiens
  IGHD2-21*01
agcatattgtggtggtgattgctattcc

SEQ ID NO: 249 - DNA, 28 bp, Homo sapiens
  IGHD2-21*02
agcatattgtggtggtgactgctattcc

SEQ ID NO: 250 - DNA, 31 bp, Homo sapiens
  IGHD2-8*01
aggatattgtactaatggtgtatgctatacc

SEQ ID NO: 251 - DNA, 31 bp, Homo sapiens
  IGHD2-8*02
aggatattgtactggtggtgtatgctatacc

SEQ ID NO: 252 - DNA, 31 bp, Homo sapiens
  IGHD3-10*01
gtattactatggttcggggagttattataac

SEQ ID NO: 253 - DNA, 30 bp, Homo sapiens
  IGHD3-10*02
gtattactatgttcggggagttattataac

SEQ ID NO: 254 - DNA, 37 bp, Homo sapiens
  IGHD3-16*01
gtattatgattacgtttgggggagttatgcttatacc

SEQ ID NO: 255 - DNA, 37 bp, Homo sapiens
  IGHD3-16*02
gtattatgattacgtttgggggagttatcgttatacc

SEQ ID NO: 256 - DNA, 31 bp, Homo sapiens
  IGHD3-22*01
gtattactatgatagtagtggttattactac

SEQ ID NO: 257 - DNA, 31 bp, Homo sapiens
  IGHD3-3*01
gtattacgatttttggagtggttattatacc

SEQ ID NO: 258 - DNA, 31 bp, Homo sapiens
  IGHD3-3*02
gtattagcatttttggagtggttattatacc

SEQ ID NO: 259 - DNA, 31 bp, Homo sapiens
  IGHD3-9*01
gtattacgatattttgactggttattataac

SEQ ID NO: 260 - DNA, 16 bp, Homo sapiens
  IGHD4-11*01
tgactacagtaactac

SEQ ID NO: 261 - DNA, 16 bp, Homo sapiens
  IGHD4-17*01
tgactacggtgactac

SEQ ID NO: 262 - DNA, 19 bp, Homo sapiens
  IGHD4-23*01
tgactacggtggtaactcc

SEQ ID NO: 263 - DNA, 16 bp, Homo sapiens
  IGHD4-4*01
tgactacagtaactac

SEQ ID NO: 264 - DNA, 23 bp, Homo sapiens
  IGHD5-12*01
gtggatatagtggctacgattac

SEQ ID NO: 265 - DNA, 20 bp, Homo sapiens
  IGHD5-18*01
gtggatacagctatggttac

SEQ ID NO: 266 - DNA, 20 bp, Homo sapiens
  IGHD5-24*01
gtagagatggctacaattac

SEQ ID NO: 267 - DNA, 20 bp, Homo sapiens
  IGHD5-5*01
gtggatacagctatggttac

SEQ ID NO: 268 - DNA, 21 bp, Homo sapiens
  IGHD6-13*01
gggtatagcagcagctggtac

SEQ ID NO: 269 - DNA, 21 bp, Homo sapiens
  IGHD6-19*01
gggtatagcagtggctggtac

SEQ ID NO: 270 - DNA, 18 bp, Homo sapiens
  IGHD6-25*01
gggtatagcagcggctac

SEQ ID NO: 271 - DNA, 18 bp, Homo sapiens
  IGHD6-6*01
gagtatagcagctcgtcc

SEQ ID NO: 272 - DNA, 11 bp, Homo sapiens
  IGHD7-27*01
ctaactgggga

SEQ ID NO: 273 - DNA, 52 bp, Homo sapiens
  IGHJ1*01
gctgaatacttccagcactggggccagggcaccctggtcaccgtctcctcag

SEQ ID NO: 274 - DNA, 53 bp, Homo sapiens
  IGHJ2*01
ctactggtacttcgatctctggggccgtggcaccctggtcactgtctcctcag

SEQ ID NO: 275 - DNA, 50 bp, Homo sapiens
  IGHJ3*01
tgatgcttttgatgtctggggccaagggacaatggtcaccgtctcttcag

SEQ ID NO: 276 - DNA, 50 bp, Homo sapiens
  IGHJ3*02
tgatgcttttgatatctggggccaagggacaatggtcaccgtctcttcag

SEQ ID NO: 277 - DNA, 48 bp, Homo sapiens
  IGHJ4*01
actactttgactactggggccaaggaaccctggtcaccgtctcctcag

SEQ ID NO: 278 - DNA, 48 bp, Homo sapiens
  IGHJ4*02
actactttgactactggggccagggaaccctggtcaccgtctcctcag

SEQ ID NO: 279 - DNA, 48 bp, Homo sapiens
  IGHJ4*03
gctactttgactactggggccaagggaccctggtcaccgtctcctcag

SEQ ID NO: 280 - DNA, 51 bp, Homo sapiens
  IGHJ5*01
acaactggttcgactcctggggccaaggaaccctggtcaccgtctcctcag

SEQ ID NO: 281 - DNA, 51 bp, Homo sapiens
  IGHJ5*02
acaactggttcgacccctggggccagggaaccctggtcaccgtctcctcag

SEQ ID NO: 282 - DNA, 63 bp, Homo sapiens
  IGHJ6*01
attactactactactacggtatggacgtctgggggcaagggaccacggtcaccgtctcctcag

SEQ ID NO: 283 - DNA, 62 bp, Homo sapiens
  IGHJ6*02
attactactactactacggtatggacgtctggggccaagggaccacggtcaccgtctcctca

SEQ ID NO: 284 - DNA, 62 bp, Homo sapiens
  IGHJ6*03
attactactactactactacatggacgtctggggcaaagggaccacggtcaccgtctcctca

SEQ ID NO: 285 - DNA, 63 bp, Homo sapiens
  IGHJ6*04
attactactactactacggtatggacgtctggggcaaagggaccacggtcaccgtctcctcag

SEQ ID NO: 286 - DNA, 287 bp, Homo sapiens
  IGKV1-12*01
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctcc

SEQ ID NO: 287 - DNA, 287 bp, Homo sapiens
  IGKV1-12*02
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccttc

SEQ ID NO: 288 - DNA, 287 bp, Homo sapiens
  IGKV1-13*02
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccctca

SEQ ID NO: 289 - DNA, 287 bp, Homo sapiens
  IGKV1-16*01
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctcc

SEQ ID NO: 290 - DNA, 287 bp, Homo sapiens
  IGKV1-17*01
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcc

SEQ ID NO: 291 - DNA, 287 bp, Homo sapiens
  IGKV1-17*02
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcaacctgcagcctgaagattttgcaacttattactgtctacagcataatagttaccctcc

SEQ ID NO: 292 - DNA, 287 bp, Homo sapiens
  IGKV1-27*01
gacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccctcc

SEQ ID NO: 293 - DNA, 287 bp, Homo sapiens
  IGKV1-33*01
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctcc

SEQ ID NO: 294 - DNA, 287 bp, Homo sapiens
  IGKV1-37*01
gacatccagttgacccagtctccatcctccctgtctgcatctgtaggagacagagtcaccatcacttgccgggtgagtcagggcattagcagttatttaaattggtatcggcagaaaccagggaaagttcctaagctcctgatctatagtgcatccaatttgcaatctggagtcccatctcggttcagtggcagtggatctgggacagatttcactctcactatcagcagcctgcagcctgaagatgttgcaacttattacggtcaacggacttacaatgcccctcc

SEQ ID NO: 295 - DNA, 287 bp, Homo sapiens
  IGKV1-39*01
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcc

SEQ ID NO: 296 - DNA, 287 bp, Homo sapiens
  IGKV1-5*01
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctatgatgcctccagtttggaaagtggggtcccatcaaggttcagcggcagtggatctgggacagaattcactctcaccatcagcagcctgcagcctgatgattttgcaacttattactgccaacagtataatagttattctcc

SEQ ID NO: 297 - DNA, 287 bp, Homo sapiens
  IGKV1-5*02
gacatccagatgacccagtctccttccaccctgtctgcatctgtaggagacagagtcaccatcatttgccgggccagtcagagtattagtagctggttggcctggtatcagcagaaaccagggaaagcccctaagctcctgatctatgatgcctccagtttggaaagtggggtcccatcaaggttcagcggcagtggatctgggacagaattcactctcaccatcagcagcctgcagcctgatgattttgcaacttattactgccaacagtataatagttattctcc

SEQ ID NO: 298 - DNA, 287 bp, Homo sapiens
  IGKV1-5*03
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattctcc

SEQ ID NO: 299 - DNA, 287 bp, Homo sapiens
  IGKV1-6*01
gccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattaccctcc

SEQ ID NO: 300 - DNA, 287 bp, Homo sapiens
  IGKV1-8*01
gccatccggatgacccagtctccatcctcattctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttaccctcc

SEQ ID NO: 301 - DNA, 287 bp, Homo sapiens
  IGKV1-9*01
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctcc

SEQ ID NO: 302 - DNA, 287 bp, Homo sapiens
  IGKV1-NL1*01
gacatccagatgacccagtctccatcctccctgtctgcatctgtaggagacagagtcaccatcacttgccgggcgagtcagggcattagcaattctttagcctggtatcagcagaaaccagggaaagcccctaagctcctgctctatgctgcatccagattggaaagtggggtcccatccaggttcagtggcagtggatctgggacggattacactctcaccatcagcagcctgcagcctgaagattttgcaacttattactgtcaacagtattatagtacccctcc

SEQ ID NO: 303 - DNA, 287 bp, Homo sapiens
  IGKV1/OR2-0*01
gacatccagatgacccagtctccatcctccctgtctgcatctgtaggagacagagtcaccatcacttgccgggcgagtcagggcattagcaataatttaaattggtatcagcagaaaccagggaaaactcctaagctcctgatctatgctgcacccagtctgcaaagtgggattccctctcggttcagtgacagtggatctggggcagattacactctcaccatccgcagcctgcagcctgaagattttgcaacttattactgtcaacagagtgacagtacccctcc

SEQ ID NO: 304 - DNA, 287 bp, Homo sapiens
  IGKV1/OR2-108*01
gacatccaggtgacccagtctccatcttccctgtctgcgtctgtaggagacagagtcaccatcacctgccgggcaagtcagggcattagcaatgggttatcctggtatcagcagaaaccagggcaagcccctacgctcctgatctatgctgcatccagtttgcagtcgggggtcccatctcggttcagtggcagtggatctgggacagatttcactctcaccatcagcagcctgcagcctgaagatgttgcaacttattactgtctacaggattatactaccccatt

SEQ ID NO: 305 - DNA, 287 bp, Homo sapiens
  IGKV1D-12*01
gacatccagatgacccagtctccatcttctgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcactatcagcagcctgcagcctgaagattttgcaacttactattgtcaacaggctaacagtttccctcc

SEQ ID NO: 306 - DNA, 287 bp, Homo sapiens; identical to SEQ ID NO: 287
  IGKV1D-12*02

SEQ ID NO: 307 - DNA, 287 bp, Homo sapiens
  IGKV1D-13*01
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaataattaccctca

SEQ ID NO: 308 - DNA, 287 bp, Homo sapiens
  IGKV1D-16*01
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctcc

SEQ ID NO: 309 - DNA, 287 bp, Homo sapiens
  IGKV1D-16*02
gacatccagatgacccagtctccatcctcactgtctgcatctgtaggagacagagtcaccatcacttgtcgggcgaggcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctcc

SEQ ID NO: 310 - DNA, 287 bp, Homo sapiens
  IGKV1D-17*01
aacatccagatgacccagtctccatctgccatgtctgcatctgtaggagacagagtcaccatcacttgtcgggcgaggcagggcattagcaattatttagcctggtttcagcagaaaccagggaaagtccctaagcacctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcc

SEQ ID NO: 311 - DNA, 287 bp, Homo sapiens; identical to SEQ ID NO: 293
  IGKV1D-33*01

SEQ ID NO: 312 - DNA, 287 bp, Homo sapiens; identical to SEQ ID NO: 294
  IGKV1D-37*01

SEQ ID NO: 313 - DNA, 287 bp, Homo sapiens; identical to SEQ ID NO: 295
  IGKV1D-39*01

SEQ ID NO: 314 - DNA, 287 bp, Homo sapiens
  IGKV1D-42*01
gacatccagatgatccagtctccatctttcctgtctgcatctgtaggagacagagtcagtatcatttgctgggcaagtgagggcattagcagtaatttagcctggtatctgcagaaaccagggaaatcccctaagctcttcctctatgatgcaaaagatttgcaccctggggtctcatcgaggttcagtggcaggggatctgggacggatttcactctcaccatcatcagcctgaagcctgaagattttgcagcttattactgtaaacaggacttcagttaccctcc

SEQ ID NO: 315 - DNA, 287 bp, Homo sapiens
  IGKV1D-43*01
gccatccggatgacccagtctccattctccctgtctgcatctgtaggagacagagtcaccatcacttgctgggccagtcagggcattagcagttatttagcctggtatcagcaaaaaccagcaaaagcccctaagctcttcatctattatgcatccagtttgcaaagtggggtcccatcaaggttcagcggcagtggatctgggacggattacactctcaccatcagcagcctgcagcctgaagattttgcaacttattactgtcaacagtattatagtacccctcc

SEQ ID NO: 316 - DNA, 287 bp, Homo sapiens
  IGKV1D-8*01
gtcatctggatgacccagtctccatccttactctctgcatctacaggagacagagtcaccatcagttgtcggatgagtcagggcattagcagttatttagcctggtatcagcaaaaaccagggaaagcccctgagctcctgatctatgctgcatccactttgcaaagtggggtcccatcaaggttcagtggcagtggatctgggacagatttcactctcaccatcagttgcctgcagtctgaagattttgcaacttattactgtcaacagtattatagtttccctcc

SEQ ID NO: 317 - DNA, 302 bp, Homo sapiens
  IGKV2-24*01
gatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatttcctca

SEQ ID NO: 318 - DNA, 302 bp, Homo sapiens
  IGKV2-28*01
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcc

SEQ ID NO: 319 - DNA, 302 bp, Homo sapiens
  IGKV2-29*02
gatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctaatctatgaagtttccagccggttctctggagtgccagataggttcagtggcagcgggtcagggacagatttcacactgaaaatcagccgggtggaggctgaggatgttggggtttattactgcatgcaaggtatacaccttcctcc

SEQ ID NO: 320 - DNA, 302 bp, Homo sapiens
  IGKV2-29*03
gatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctgatctatgaagtttccagccggttctctggagtgccagataggttcagtggcagcgggtcagggacagatttcacactgaaaatcagccgggtggaggctgaggatgttggggtttattactgcatgcaaggtatacaccttcctcc

SEQ ID NO: 321 - DNA, 302 bp, Homo sapiens
  IGKV2-30*01
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctcc

SEQ ID NO: 322 - DNA, 305 bp, Homo sapiens
  IGKV2-40*01
gatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttccttc

SEQ ID NO: 323 - DNA, 251 bp, Homo sapiens
  IGKV2-40*02
gcctccatctcctgcaggtctagtcagagcctcttggatagtgatgatggaaacacctatttggattgttacctgcagaagccagggcagtctccacagctcctgatctatacgctttcctatcgggcctctggagtcccagacaggttcagtgacagtgggtcaggcactgatttcacactgaaaatcagcagggtggaggctgaggatgttggagtttattactgcatgcaacgtatagagtttccttc

SEQ ID NO: 324 - DNA, 302 bp, Homo sapiens
  IGKV2D-24*01
gatattgtgatgacccagactccactctcctcgcctgtcacccttggacagccggcctccatctccttcaggtctagtcaaagcctcgtacacagtgatggaaacacctacttgagttggcttcagcagaggccaggccagcctccaagactcctaatttataaggtttctaaccggttctctggggtcccagacagattcagtggcagtggggcagggacagatttcacactgaaaatcagcagggtggaagctgaggatgtcggggtttattactgcacgcaagctacacaatttcctca

SEQ ID NO: 325 - DNA, 302 bp, Homo sapiens
  IGKV2D-26*01
gagattgtgatgacccagactccactctccttgtctatcacccctggagagcaggcctccatctcctgcaggtctagtcagagcctcctgcatagtgatggatacacctatttgtattggtttctgcagaaagccaggccagtctccacactcctgatctatgaagtttccaaccggttctctggagtgccagataggttcagtggcagcgggtcagggacagatttcacactgaaaatcagccgggtggaggctgaggattttggagtttattactgcatgcaagatgcacaagatcctcc

SEQ ID NO: 326 - DNA, 300 bp, Homo sapiens
  IGKV2D-26*02
gagattgtgatgacccagactccactctccttgtctatcacccctggagagcaggcctccatgtcctgcaggtctagtcagagcctcctgcatagtgatggatacacctatttgtattggtttctgcagaaagccaggccagtctccacgctcctgatctgtgaagtttccaaccggttctctggagtgccagataggttcagtggcagcgggtcagggacagatttcacactgaaaatcagccgggtggaggctgaggattttggagtttattactgcatgcaagatgcacaagatcct

SEQ ID NO: 327 - DNA, 302 bp, Homo sapiens; identical to SEQ ID NO: 318
  IGKV2D-28*01

SEQ ID NO: 328 - DNA, 302 bp, Homo sapiens
  IGKV2D-29*01
gatattgtgatgacccagactccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttcctcc

SEQ ID NO: 329 - DNA, 302 bp, Homo sapiens
  IGKV2D-29*02
gatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttcctcc

SEQ ID NO: 330 - DNA, 302 bp, Homo sapiens
  IGKV2D-30*01
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggtttattactgcatgcaaggtacacactggcctcc

SEQ ID NO: 331 - DNA, 305 bp, Homo sapiens; identical to SEQ ID NO: 322
  IGKV2D-40*01

SEQ ID NO: 332 - DNA, 287 bp, Homo sapiens
  IGKV3-11*01
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcc

SEQ ID NO: 333 - DNA, 287 bp, Homo sapiens
  IGKV3-11*02
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggagagacttcactctcaccatcagcagcctagagcctgaagattttgcagtttattactgtcagcagcgtagcaactggcctcc

SEQ ID NO: 334 - DNA, 287 bp, Homo sapiens
  IGKV3-15*01
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcc

SEQ ID NO: 335 - DNA, 290 bp, Homo sapiens
  IGKV3-20*01
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcc

SEQ ID NO: 336 - DNA, 271 bp, Homo sapiens
  IGKV3-20*02
gaaattgtgttgacacagtctccagccaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagcaaggttcagtggcagtgggtctgggacagacttcactctcaccatcagcagactggagcctgaagattttgcagtttattactgtcagc

SEQ ID NO: 337 - DNA, 290 bp, Homo sapiens
  IGKV3-7*01
gaaattgtaatgacacagtctccacccaccctgtctttgtctccaggggaaagagtcaccctctcctgcagggccagtcagagtgttagcagcagctacttaacctggtatcagcagaaacctggccaggcgcccaggctcctcatctatggtgcatccaccagggccactagcatcccagccaggttcagtggcagtgggtctgggacagacttcactctcaccatcagcagcctgcagcctgaagattttgcagtttattactgtcagcaggatcataacttacctcc

SEQ ID NO: 338 - DNA, 290 bp, Homo sapiens
  IGKV3-7*02
gaaattgtaatgacacagtctccacccaccctgtctttgtctccaggggaaagagtcaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcc

SEQ ID NO: 339 - DNA, 290 bp, Homo sapiens
  IGKV3-7*03
gaaattgtaatgacacagtctccacccaccctgtctttgtctccaggggaaagagtcaccctctcctgcagggccagtcagagtgttagcagcagctacttaacctggtatcagcagaaacctggccaggcgcccaggctcctcatctatggtgcatccaccagggccactagcatcccagccaggttcagtggcagtgggtctgggagagacttcactctcaccatcagcagcctgcagcctgaagattttgcagtttattactgtcagcaggatcataacttacctcc

SEQ ID NO: 340 - DNA, 268 bp, Homo sapiens
  IGKV3-NL1*01
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatggtgcatccaccagggccactggcatcccagccaggttcagtggcagtgggtctgggacagagttcactctcaccatcagcagcctgcagtctgaagattttgcagtttattactgtcagc

SEQ ID NO: 341 - DNA, 268 bp, Homo sapiens
  IGKV3-NL2*01
gaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccagcagggccactggcatcccagccaggttcagtggcagtgggcctgggacagacttcactctcaccatcagcagcctagagcctgaagattttgcagtttattactgtcagc

SEQ ID NO: 342 - DNA, 271 bp, Homo sapiens
  IGKV3-NL3*01
gaaattgtgttgacacagtctccaggcaccctgtctttgtctccaggggaaagagccaccctctcctgcagggccagtcagagtgttagcagcagctacttagcctggtaccagcagaaacctggcctggcgcccaggctcctcatctatggtgcatccaccagggccactggtatcccagccaggttcagtggcagtgggtctgggacagagttcactctcaccatcagcagactgcagtctgaagattttgcagtttattactgtcagc

SEQ ID NO: 343 - DNA, 285 bp, Homo sapiens
  IGKV3-NL4*01
gaaattgtgttgacacagtctccagccaccctgtctttgtctccaggggaaagagccaccctctcctgcagggccagtcagggtgttagcagcaacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtgtattactgtcagcagcgtagcaactggcat

SEQ ID NO: 344 - DNA, 288 bp, Homo sapiens
  IGKV3-NL5*01
gaaattgtgttgacgcagtctccagccaccctgtctttgtctccaggggaaagagccaccctctcctgcagggccagtcagagtgttagcagcagctacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtctattactgtcagcagcgtagcaactggcat

SEQ ID NO: 345 - DNA, 290 bp, Homo sapiens
  IGKV3/OR2-268*01
gaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggtagtgggtctgggacagacttcactctcaccatcagcagcctgcagcctgaagattttgcagtttattactgtcagcaggattataacttacctcc

SEQ ID NO: 346 - DNA, 290 bp, Homo sapiens
  IGKV3/OR2-268*02
gaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcc

SEQ ID NO: 347 - DNA, 287 bp, Homo sapiens
  IGKV3D-11*01
gaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaactggcatcc

SEQ ID NO: 348 - DNA, 287 bp, Homo sapiens
  IGKV3D-15*01
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggcatcccagccaggttcagtggcagtgggtctgggacagagttcactctcaccatcagcagcctgcagtctgaagattttgcagtttattactgtcagcagtataataactggcctcc

SEQ ID NO: 349 - DNA, 290 bp, Homo sapiens
  IGKV3D-20*01
gaaattgtgttgacgcagtctccagccaccctgtctttgtctccaggggaaagagccaccctctcctgcggggccagtcagagtgttagcagcagctacttagcctggtaccagcagaaacctggcctggcgcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcc

SEQ ID NO: 350 - DNA, 290 bp, Homo sapiens; identical to SEQ ID NO: 346
  IGKV3D-7*01

SEQ ID NO: 351 - DNA, 305 bp, Homo sapiens
  IGKV4-1*01
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcc

SEQ ID NO: 352 - DNA, 287 bp, Homo sapiens
  IGKV5-2*01
gaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccctct

SEQ ID NO: 353 - DNA, 287 bp, Homo sapiens
  IGKV6-21*01
gaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccttctcaggggtcccctcgaggttcagtggcagtggatctgggacagatttcaccctcaccatcaatagcctggaagctgaagatgctgcaacgtattactgtcatcagagtagtagtttacctca

SEQ ID NO: 354 - DNA, 287 bp, Homo sapiens; identical to SEQ ID NO: 353
  IGKV6D-21*01

SEQ ID NO: 355 - DNA, 287 bp, Homo sapiens
  IGKV6D-41*01
gatgttgtgatgacacagtctccagctttcctctctgtgactccaggggagaaagtcaccatcacctgccaggccagtgaaggcattggcaactacttatactggtaccagcagaaaccagatcaagccccaaagctcctcatcaagtatgcttcccagtccatctcaggggtcccctcgaggttcagtggcagtggatctgggacagatttcacctttaccatcagtagcctggaagctgaagatgctgcaacatattactgtcagcagggcaataagcaccctca

SEQ ID NO: 356 - DNA, 38 bp, Homo sapiens
  IGKJ1*01
gtggacgttcggccaagggaccaaggtggaaatcaaac

SEQ ID NO: 357 - DNA, 39 bp, Homo sapiens
  IGKJ2*01
tgtacacttttggccaggggaccaagctggagatcaaac

SEQ ID NO: 358 - DNA, 38 bp, Homo sapiens
  IGKJ2*02
gtgcacttttggccaggggaccaagctggagatcaaac

SEQ ID NO: 359 - DNA, 39 bp, Homo sapiens
  IGKJ2*03
tgtacagttttggccaggggaccaagctggagatcaaac

SEQ ID NO: 360 - DNA, 39 bp, Homo sapiens
  IGKJ2*04
tgtgcagttttggccaggggaccaagctggagatcaaac

SEQ ID NO: 361 - DNA, 38 bp, Homo sapiens
  IGKJ3*01
attcactttcggccctgggaccaaagtggatatcaaac

SEQ ID NO: 362 - DNA, 38 bp, Homo sapiens
  IGKJ4*01
gctcactttcggcggagggaccaaggtggagatcaaac

SEQ ID NO: 363 - DNA, 38 bp, Homo sapiens
  IGKJ4*02
gctcacgttcggcggagggaccaaggtggagatcaaac

SEQ ID NO: 364 - DNA, 38 bp, Homo sapiens
  IGKJ5*01
gatcaccttcggccaagggacacgactggagattaaac

SEQ ID NO: 365 - DNA, 296 bp, Homo sapiens
  IGLV1-36*01
cagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggtcc

SEQ ID NO: 366 - DNA, 299 bp, Homo sapiens
  IGLV1-40*01
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttc

SEQ ID NO: 367 - DNA, 299 bp, Homo sapiens
  IGLV1-40*02
cagtctgtcgtgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttc

SEQ ID NO: 368 - DNA, 297 bp, Homo sapiens
  IGLV1-40*03
cagtctgtcgtgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcgcctcagcctccctggccatcactgggctccaggctgaggatgaggctgattattactgccagtcctatgacagcagcctgagtggt

SEQ ID NO: 369 - DNA, 296 bp, Homo sapiens
  IGLV1-41*01
cagtctgtgttgacgcagccgccttcagtgtctgcggccccaggacagaaggtcaccatctcctgctctggaagcagctccgacatggggaattatgcggtatcctggtaccagcagctcccaggaacagcccccaaactcctcatctatgaaaataataagcgaccctcagggattcctgaccgattctctggctccaagtctggcacctcagccaccctgggcatcactggcctctggcctgaggacgaggccgattattactgcttagcatgggataccagcccgagagcttg

SEQ ID NO: 370 - DNA, 296 bp, Homo sapiens
  IGLV1-44*01
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcc

SEQ ID NO: 371 - DNA, 296 bp, Homo sapiens
  IGLV1-47*01
cagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtcc

SEQ ID NO: 372 - DNA, 296 bp, Homo sapiens
  IGLV1-47*02
cagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgagtggtcc

SEQ ID NO: 373 - DNA, 299 bp, Homo sapiens
  IGLV1-50*01
cagtctgtgctgacgcagccgccctcagtgtctggggccccagggcagagggtcaccatctcctgcactgggagcagctccaacattggggcgggttatgttgtacattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgaatgctca

SEQ ID NO: 374 - DNA, 296 bp, Homo sapiens
  IGLV1-51*01
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctgg

SEQ ID NO: 375 - DNA, 296 bp, Homo sapiens
  IGLV1-51*02
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatctatgaaaataataagcgaccctcagggattcctgaccgattctctggctccaagtctggcacgtcagccaccctgggcatcaccggactccagactggggacgaggccgattattactgcggaacatgggatagcagcctgagtgctgg

SEQ ID NO: 376 - DNA, 296 bp, Homo sapiens
  IGLV10-54*01
caggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgctca

SEQ ID NO: 377 - DNA, 296 bp, Homo sapiens
  IGLV10-54*02
caggcagggctgactcagccaccctcggtgtccaagggcttgagacagaccgccacactcacctgcactgggaacagcaacattgttggcaaccaaggagcagcttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcattggacagcagcctcagtgctca

SEQ ID NO: 378 - DNA, 296 bp, Homo sapiens
  IGLV10-54*03
caggcagggctgactcagccaccctcggtctccaagggcttgagacagaccgccacactcacctgcactgggaacagcaacaatgttggcaaccaaggagcagcttggcctgagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgctca

SEQ ID NO: 379 - DNA, 312 bp, Homo sapiens
  IGLV11-55*01
cggcccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgctaat

SEQ ID NO: 380 - DNA, 297 bp, Homo sapiens
  IGLV2-11*01
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttc

SEQ ID NO: 381 - DNA, 297 bp, Homo sapiens
  IGLV2-11*02
cagtctgccctgactcagcctcgctcagtgtccgggtctcctggacagtcagtcaccatctcctgcactggaaccagcagtgatgttggtgggtataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttc

SEQ ID NO: 382 - DNA, 274 bp, Homo sapiens
  IGLV2-11*03
ctcagtgtccgggtctcctggacagtcagtcaccatctcctgcactggaaccagcagtgatgttggtggttataactatgtctcctggtaccaacaacacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttc

SEQ ID NO: 383 - DNA, 297 bp, Homo sapiens
  IGLV2-14*01
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctc

SEQ ID NO: 384 - DNA, 297 bp, Homo sapiens
  IGLV2-14*02
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgaccatctctgggctccaggctgaggacgaggctgattattactgcagctcatatacaagcagcagcactctc

SEQ ID NO: 385 - DNA, 274 bp, Homo sapiens
  IGLV2-14*03
ctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctc

SEQ ID NO: 386 - DNA, 274 bp, Homo sapiens
  IGLV2-14*04
ctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctc

SEQ ID NO: 387 - DNA, 297 bp, Homo sapiens
  IGLV2-18*01
cagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagcttatatacaagcagcagcactttc

SEQ ID NO: 388 - DNA, 297 bp, Homo sapiens
  IGLV2-18*02
cagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagctcatatacaagcagcagcactttc

SEQ ID NO: 389 - DNA, 297 bp, Homo sapiens
  IGLV2-18*03
cagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccacctctgggctccaggctgaggacgaggctgattattactgcagctcatatacaagcagcagcactttc

SEQ ID NO: 390 - DNA, 297 bp, Homo sapiens
  IGLV2-18*04
cagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgctcctctgggtccaagtccggcaacacggcctccctgaccatctctgggctccaggctgaggacgaggctgattattactgcagctcatatacaagcagcagcactttc

SEQ ID NO: 391 - DNA, 298 bp, Homo sapiens
  IGLV2-23*01
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttac

SEQ ID NO: 392 - DNA, 297 bp, Homo sapiens
  IGLV2-23*02
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtagtagcactttc

SEQ ID NO: 393 - DNA, 297 bp, Homo sapiens
  IGLV2-23*03
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttc

SEQ ID NO: 394 - DNA, 297 bp, Homo sapiens
  IGLV2-33*01
caatctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttacactttc

SEQ ID NO: 395 - DNA, 297 bp, Homo sapiens
  IGLV2-33*02
cagtctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttacactttc

SEQ ID NO: 396 - DNA, 297 bp, Homo sapiens
  IGLV2-33*03
caatctgccctgactcagcctccttttgtgtccggggctcctggacagtcggtcaccatctcctgcactggaaccagcagtgacgttggggactatgatcatgtcttctggtaccaaaagcgtctcagcactacctccagactcctgatttacaatgtcaatactcggccttcagggatctctgacctcttctcaggctccaagtctggcaacgtggcttccctgaccatctctgggctcaagtccgaggttgaggctaattatcactgcagcttatattcaagtagttacactttc

SEQ ID NO: 397 - DNA, 297 bp, Homo sapiens
  IGLV2-8*01
cagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttc

SEQ ID NO: 398 - DNA, 297 bp, Homo sapiens
  IGLV2-8*02
cagtctgccctgactcagcctccctccgcgtccaggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttc

SEQ ID NO: 399 - DNA, 274 bp, Homo sapiens
  IGLV2-8*03
ctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctttggctccaagtctggcaacacggcctccctgaccgtctctgggctccaggctgaggatgaggctgattattactgcagctcatatgcaggcagcaacaatttc

SEQ ID NO: 400 - DNA, 285 bp, Homo sapiens
  IGLV3-1*01
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgca

SEQ ID NO: 401 - DNA, 290 bp, Homo sapiens
  IGLV3-10*01
tcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaatcatag

SEQ ID NO: 402 - DNA, 285 bp, Homo sapiens
  IGLV3-10*02
tcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctataaggacagcaaacgaccctcagggatccctgagagattctctggctccagctcagggacaatggccaccttgaccatcagtggggcccaggtggaggatgaagatgactactactgttactcagcagactacagtggtaat

SEQ ID NO: 403 - DNA, 290 bp, Homo sapiens
  IGLV3-12*01
tcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccaccaccctaaccatcagcaggatcgaggctggggatgaggctgactattactgtcaggtgtgggacagtagtagtgatcatcc

SEQ ID NO: 404 - DNA, 290 bp, Homo sapiens
  IGLV3-12*02
tcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgatcatcc

SEQ ID NO: 405 - DNA, 290 bp, Homo sapiens
  IGLV3-16*01
tcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtggtacttatcc

SEQ ID NO: 406 - DNA, 290 bp, Homo sapiens
  IGLV3-19*01
tcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatct

SEQ ID NO: 407 - DNA, 290 bp, Homo sapiens
  IGLV3-21*01
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggacagtagtagtgatcatcc

SEQ ID NO: 408 - DNA, 290 bp, Homo sapiens
  IGLV3-21*02
tcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatcc

SEQ ID NO: 409 - DNA, 290 bp, Homo sapiens
  IGLV3-21*03
tcctatgtgctgactcagccaccctcggtgtcagtggccccaggaaagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatcc

SEQ ID NO: 410 - DNA, 284 bp, Homo sapiens
  IGLV3-22*01
tcctatgagctgacacagctaccctcggtgtcagtgtccccaggacagacagccaggatcacctgctctggagatgtactgggggaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctggggatgaggacaatcc

SEQ ID NO: 411 - DNA, 290 bp, Homo sapiens
  IGLV3-25*01
tcctatgagctgatgcagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtacttatcc

SEQ ID NO: 412 - DNA, 290 bp, Homo sapiens
  IGLV3-25*02
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtacttatcc

SEQ ID NO: 413 - DNA, 282 bp, Homo sapiens
  IGLV3-25*03
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggt

SEQ ID NO: 414 - DNA, 284 bp, Homo sapiens
  IGLV3-27*01
tcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaatct

SEQ ID NO: 415 - DNA, 284 bp, Homo sapiens
  IGLV3-32*01
tcctctgggccaactcaggtgcctgcagtgtctgtggccttgggacaaatggccaggatcacctgccagggagacagcatggaaggctcttatgaacactggtaccagcagaagccaggccaggcccccgtgctggtcatctatgatagcagtgaccggccctcaaggatccctgagcgattctctggctccaaatcaggcaacacaaccaccctgaccatcactggggcccaggctgaggatgaggctgattattactatcagttgatagacaaccatgctac

SEQ ID NO: 416 - DNA, 285 bp, Homo sapiens
  IGLV3-9*01
tcctatgagctgactcagccactctcagtgtcagtggccctgggacagacggccaggattacctgtgggggaaacaacattggaagtaaaaatgtgcactggtaccagcagaagccaggccaggcccctgtgctggtcatctatagggatagcaaccggccctctgggatccctgagcgattctctggctccaactcggggaacacggccaccctgaccatcagcagagcccaagccggggatgaggctgactattactgtcaggtgtgggacagcagcactgca

SEQ ID NO: 417 - DNA, 290 bp, Homo sapiens
  IGLV3-9*02
tcctatgagctgactcagccactctcagtgtcagtggccctgggacaggcggccaggattacctgtgggggaaacaaccttggatataaaagtgtgcactggtaccagcagaagccaggccaggcccctgtgctggtcatctatagggataacaaccggccctctgggatccctgagcgattctctggctccaactcggggaacacggccaccctgaccatcagcagagcccaagccggggatgaggctgactattactgtcaggtgtgggacagcagcactgcacaccc

SEQ ID NO: 418 - DNA, 314 bp, Homo sapiens
  IGLV4-3*01
ctgcctgtgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcggttgagc

SEQ ID NO: 419 - DNA, 297 bp, Homo sapiens
  IGLV4-60*01
cagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagttagaggatgaggctgattattactgtgagacctgggacagtaacact

SEQ ID NO: 420 - DNA, 299 bp, Homo sapiens
  IGLV4-60*02
cagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactca

SEQ ID NO: 421 - DNA, 297 bp, Homo sapiens
  IGLV4-60*03
cagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtctgaggatgaggctgattattactgtgagacctgggacagtaacact

SEQ ID NO: 422 - DNA, 299 bp, Homo sapiens
  IGLV4-69*01
cagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactggcattca

SEQ ID NO: 423 - DNA, 299 bp, Homo sapiens
  IGLV4-69*02
cagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagtaagggggacgggatccctgatcgcttctcaggctccagctctggggctgagcgctacctcaccatctccagcctccagtctgaggatgaggctgactattactgtcagacctggggcactggcattca

SEQ ID NO: 424 - DNA, 312 bp, Homo sapiens
  IGLV5-37*01
cagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgcttct

SEQ ID NO: 425 - DNA, 312 bp, Homo sapiens
  IGLV5-39*01
cagcctgtgctgactcagccaacctccctctcagcatctcctggagcatcagccagattcacctgcaccttgcgcagtggcatcaatgttggtacctacaggatatactggtaccagcagaagccagggagtcttccccggtatctcctgaggtacaaatcagactcagataagcagcagggctctggagtccccagccgcttctctggatccaaagatgcttcaaccaatgcaggccttttactcatctctgggctccagtctgaagatgaggctgactattactgtgccatttggtacagcagcacttct

SEQ ID NO: 426 - DNA, 312 bp, Homo sapiens
  IGLV5-39*02
cagcctgtgctgactcagccaacctccctctcagcatctcctggagcatcagccagattcacctgcaccttgcgcagcggcatcaatgttggtacctacaggatatactggtaccagcagaatccagggagtcttccccggtatctcctgaggtacaaatcagactcagataagcagcagggctctggagtccccagccgcttctctggatccaaagatgcttcaaccaatgcaggccttttactcatctctgggctccagtctgaagatgaggctgactattactgtgccatttggtacagcagcacttct

SEQ ID NO: 427 - DNA, 312 bp, Homo sapiens
  IGLV5-45*01
caggctgtgctgactcagccggcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgcttct

SEQ ID NO: 428 - DNA, 312 bp, Homo sapiens
  IGLV5-45*02
caggctgtgctgactcagccgtcttccctctctgcatctcctggagcatcagccagtctcacctgcaccttacgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgcttct

SEQ ID NO: 429 - DNA, 312 bp, Homo sapiens
  IGLV5-45*03
caggctgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgcttct

SEQ ID NO: 430 - DNA, 312 bp, Homo sapiens
  IGLV5-48*01
cagcctgtgctgactcagccaacttccctctcagcatctcctggagcatcagccagactcacctgcaccttgcgcagtggcatcaatcttggtagctacaggatattctggtaccagcagaagccagagagccctccccggtatctcctgagctactactcagactcaagtaagcatcagggctctggagtccccagccgcttctctggatccaaagatgcttcgagcaatgcagggattttagtcatctctgggctccagtctgaggatgaggctgactattactgtatgatttggcacagcagtgcttct

SEQ ID NO: 431 - DNA, 317 bp, Homo sapiens
  IGLV5-52*01
cagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctaagactca

SEQ ID NO: 432 - DNA, 296 bp, Homo sapiens
  IGLV6-57*01
aattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatca

SEQ ID NO: 433 - DNA, 294 bp, Homo sapiens
  IGLV7-43*01
cagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgctcag

SEQ ID NO: 434 - DNA, 294 bp, Homo sapiens
  IGLV7-46*01
caggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgaccctttcgggtgcgcagcctgaggatgaggctgagtattactgcttgctctcctatagtggtgctcgg

SEQ ID NO: 435 - DNA, 294 bp, Homo sapiens
  IGLV7-46*02
caggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgctcgg

SEQ ID NO: 436 - DNA, 296 bp, Homo sapiens
  IGLV8-61*01
cagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttc

SEQ ID NO: 437 - DNA, 296 bp, Homo sapiens
  IGLV8-61*02
cagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgattgcttctctggctccatccttgggaacaaagctgccctcaccatcacgggggcccaggcagatgatgaatctgattattactgtgtgctgtatatgggtagtggcatttc

SEQ ID NO: 438 - DNA, 247 bp, Homo sapiens
  IGLV8-61*03
ggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggcgtccctgatcgcttctctggctccatccttgggaacaaagctgccctcaccatcacgggggcccaggcagatgatgaa

SEQ ID NO: 439 - DNA, 317 bp, Homo sapiens
  IGLV9-49*01
cagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcgtgtaacc

SEQ ID NO: 440 - DNA, 317 bp, Homo sapiens
  IGLV9-49*02
cagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaagatgagagtgactaccactgtggggcagaccatggcagtgggagcaacttcgtgtaacc

SEQ ID NO: 441 - DNA, 317 bp, Homo sapiens
  IGLV9-49*03
cagcctgtgctgactcagccaccttctgcatcagcctccctgggagcctcggtcacactcacctgcaccctgagcagcggctacagtaattataaagtggactggtaccagcagagaccagggaagggcccccgatttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcgtgtaacc

SEQ ID NO: 442 - DNA, 38 bp, Homo sapiens
  IGLJ1*01
ttatgtcttcggaactgggaccaaggtcaccgtcctag

SEQ ID NO: 443 - DNA, 38 bp, Homo sapiens
  IGLJ2*01
tgtggtattcggcggagggaccaagctgaccgtcctag

SEQ ID NO: 444 - DNA, 38 bp, Homo sapiens; identical to SEQ ID NO: 443
  IGLJ3*01

SEQ ID NO: 445 - DNA, 38 bp, Homo sapiens
  IGLJ3*02
ttgggtgttcggcggagggaccaagctgaccgtcctag

SEQ ID NO: 446 - DNA, 38 bp, Homo sapiens
  IGLJ4*01
ttttgtatttggtggaggaacccagctgatcattttag

SEQ ID NO: 447 - DNA, 38 bp, Homo sapiens
  IGLJ5*01
ctgggtgtttggtgaggggaccgagctgaccgtcctag

SEQ ID NO: 448 - DNA, 38 bp, Homo sapiens
  IGLJ5*02
ctgggtgtttggtgaggggacggagctgaccgtcctag

SEQ ID NO: 449 - DNA, 38 bp, Homo sapiens
  IGLJ6*01
taatgtgttcggcagtggcaccaaggtgaccgtcctcg

SEQ ID NO: 450 - DNA, 38 bp, Homo sapiens
  IGLJ7*01
tgctgtgttcggaggaggcacccagctgaccgtcctcg

SEQ ID NO: 451 - DNA, 38 bp, Homo sapiens
  IGLJ7*02
tgctgtgttcggaggaggcacccagctgaccgccctcg

SEQ ID NO: 452 - DNA, 374 bp, Artificial Sequence
  gnl|Fabrus|HerceptinHC
ccatggcaaaggtgcagctggttgaaagcggcggcggtctggtgcagccgggcggtagcctgcgcctgagctgcgcggcgagcggctttaacattaaagatacctatattcattgggtgcgccaggcgccgggtaaaggcctggaatgggtggcgcgcatttatccgaccaatggttatacccgttatgcggatagcgtgaaaggtcgttttaccatcagcgcggataccagcaaaaacaccgcctatctgcagatgaatagcctgcgcgcggaagataccgcggtgtattattgtagccgttggggcggcgatggcttttatgcgatggattattggggccagggcaccctggtgaccgtgagcagcgctagc

SEQ ID NO: 453 - DNA, 377 bp, Artificial Sequence
  gnl|Fabrus|Anti-CD20 HC
ccatggcacaggcctacctgcagcagagcggcgccgagctggtgaggcccggcgccagcgtgaagatgagctgcaaggccagcggctacaccttcaccagctacaacatgcactgggtgaagcagacccccaggcagggcctggagtggatcggcgccatctaccccggcaacggcgacaccagctacaaccagaagttcaagggcaaggccaccctgaccgtggacaagagcagcagcaccgcctacatgcagctgagcagcctgaccagcgaggacagcgccgtgtacttctgcgccagggtggtgtactacagcaacagctactggtacttcgacgtgtggggcaccggcaccaccgtgaccgtgagcgctagc

SEQ ID NO: 454 - DNA, 380 bp, Artificial Sequence
  gnl|Fabrus|VH1-18_IGHD1-26*01_IGHJ2*01
ccatggcacaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagggtatagtgggagctactactactggtacttcgatctctggggccgtggcaccctggtcactgtctcctcagctagc

SEQ ID NO: 455 - DNA, 389 bp, Artificial Sequence
  gnl|Fabrus|VH1-18_IGHD2-21*01_IGHJ2*01
ccatggcacaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagaagcatattgtggtggtgattgctattcctactggtacttcgatctctggggccgtggcaccctggtcactgtctcctcagctagc

SEQ ID NO: 456 - DNA, 410 bp, Artificial Sequence
  gnl|Fabrus|VH1-18_IGHD3-16*01_IGHJ6*01
ccatggcacaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagagtattatgattacgtttgggggagttatgcttataccgattactactactactacggtatggacgtctgggggcaagggaccacggtcaccgtctcctcagctagc

SEQ ID NO: 457 - DNA, 389 bp, Artificial Sequence
  gnl|Fabrus|VH1-18_IGHD3-22*01_IGHJ4*01
ccatggcacaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagagtattactatgatagtagtggttattactacgactactttgactactggggccaaggaaccctggtcaccgtctcctcagctagc

SEQ ID NO: 458 - DNA, 380 bp, Artificial Sequence
  gnl|Fabrus|VH1-18_IGHD4-23*01_IGHJ1*01
ccatggcacaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagatgactacggtggtaactccgctgaatacttccagcactggggccagggcaccctggtcaccgtctcctcagctagc

SEQ ID NO: 459 - DNA, 380 bp, Artificial Sequence
  gnl|Fabrus|VH1-18_IGHD5-12*01_IGHJ4*01
ccatggcacaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagaggtggatatagtggctacgattacgactactttgactactggggccaaggaaccctggtcaccgtctcctcagctagc

SEQ ID NO: 460 - DNA, 380 bp, Artificial Sequence
  gnl|Fabrus|VH1-18_IGHD6-6*01_IGHJ1*01
ccatggcacaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagaggagtatagcagctcgtccgctgaatacttccagcactggggccagggcaccctggtcaccgtctcctcagctagc

SEQ ID NO: 461 - DNA, 374 bp, Artificial Sequence
  gnl|Fabrus|VH1-2_IGHD1-1*01_IGHJ3*01
ccatggcacaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagggtacaactggaacgacgatgcttttgatgtctggggccaagggacaatggtcaccgtctcttcagctagc

SEQ ID NO: 462 - DNA, 374 bp, Artificial Sequence
  gnl|Fabrus|VH1-24_IGHD1-7*01_IGHJ4*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagggtataactggaactacgactactttgactactggggccaaggaaccctggtcaccgtctcctcagctagc

SEQ ID NO: 463 - DNA, 392 bp, Artificial Sequence
  gnl|Fabrus|VH1-24_IGHD2-15*01_IGHJ2*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagaaggatattgtagtggtggtagctgctactcctactggtacttcgatctctggggccgtggcaccctggtcactgtctcctcagctagc

SEQ ID NO: 464 - DNA, 389 bp, Artificial Sequence
  gnl|Fabrus|VH1-24_IGHD3-10*01_IGHJ4*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagagtattactatggttcggggagttattataacgactactttgactactggggccaaggaaccctggtcaccgtctcctcagctagc

SEQ ID NO: 465 - DNA, 395 bp, Artificial Sequence
  gnl|Fabrus|VH1-24_IGHD3-16*01_IGHJ4*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagagtattatgattacgtttgggggagttatgcttataccgactactttgactactggggccaaggaaccctggtcaccgtctcctcagctagc

SEQ ID NO: 466 - DNA, 380 bp, Artificial Sequence
  gnl|Fabrus|VH1-24_IGHD4-23*01_IGHJ2*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagatgactacggtggtaactcctactggtacttcgatctctggggccgtggcaccctggtcactgtctcctcagctagc

SEQ ID NO: 467 - DNA, 380 bp, Artificial Sequence
  gnl|Fabrus|VH1-24_IGHD5-12*01_IGHJ4*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacaggtggatatagtggctacgattacgactactttgactactggggccaaggaaccctggtcaccgtctcctcagctagc

SEQ ID NO: 468 - DNA, 392 bp, Artificial Sequence
  gnl|Fabrus|VH1-24_IGHD5-18*01_IGHJ6*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacaggtggatacagctatggttacgattactactactactacggtatggacgtctgggggcaagggaccacggtcaccgtctcctcagctagc

SEQ ID NO: 469 - DNA, 380 bp, Artificial Sequence
  gnl|Fabrus|VH1-24_IGHD6-19*01_IGHJ4*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagaggggtatagcagtggctggtacgactactttgactactggggccaaggaaccctggtcaccgtctcctcagctagc

SEQ ID NO: 470 - DNA, 392 bp, Artificial Sequence
  gnl|Fabrus|VH1-3_IGHD2-15*01_IGHJ2*01
ccatggcacaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagaaggatattgtagtggtggtagctgctactcctactggtacttcgatctctggggccgtggcaccctggtcactgtctcctcagctagc

SEQ ID NO: 471 - DNA, 392 bp, Artificial Sequence
  gnl|Fabrus|VH1-3_IGHD2-2*01_IGHJ5*01
ccatggcacaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagaaggatattgtagtagtaccagctgctatgccgacaactggttcgactcctggggccaaggaaccctggtcaccgtctcctcagctagc

SEQ ID NO: 472 - DNA, 404 bp, Artificial Sequence
  gnl|Fabrus|VH1-3_IGHD3-9*01_IGHJ6*01
ccatggcacaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagagtattacgatattttgactggttattataacgattactactactactacggtatggacgtctgggggcaagggaccacggtcaccgtctcctcagctagc

SEQ ID NO: 473 - DNA, 377 bp, Artificial Sequence
  gnl|Fabrus|VH1-3_IGHD4-23*01_IGHJ4*01
ccatggcacaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagatgactacggtggtaactccgactactttgactactggggccaaggaaccctggtcaccgtctcctcagctagc

SEQ ID NO: 474 - DNA, 377 bp, Artificial Sequence
  gnl|Fabrus|VH1-3_IGHD5-18*01_IGHJ4*01
ccatggcacaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagaggtggatacagctatggttacgactactttgactactggggccaaggaaccctggtcaccgtctcctcagctagc

SEQ ID NO: 475 - DNA, 380 bp, Artificial Sequence
  gnl|Fabrus|VH1-3_IGHD6-6*01_IGHJ1*01
ccatggcacaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagaggagtatagcagctcgtccgctgaatacttccagcactggggccagggcaccctggtcaccgtctcctcagctagc

SEQ ID NO: 476 - DNA, 368 bp, Artificial Sequence
  gnl|Fabrus|VH1-3_IGHD7-27*01_IGHJ4*01
ccatggcacaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagctaactggggagactactttgactactggggccaaggaaccctggtcaccgtctcctcagctagc

SEQ ID NO: 477 - DNA, 377 bp, Artificial Sequence
  gnl|Fabrus|VH1-45_IGHD1-26*01_IGHJ4*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatggtatagtgggagctactacgactactttgactactggggccaaggaaccctggtcaccgtctcctcagctagc

SEQ ID NO: 478 - DNA, 404 bp, Artificial Sequence
  gnl|Fabrus|VH1-45_IGHD2-15*01_IGHJ6*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatatggatattgtagtggtggtagctgctactccgattactactactactacggtatggacgtctgggggcaagggaccacggtcaccgtctcctcagctagc

SEQ ID NO: 479 - DNA, 389 bp, Artificial Sequence
  gnl|Fabrus|VH1-45_IGHD2-8*01_IGHJ3*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatatggatattgtactaatggtgtatgctataccgatgcttttgatgtctggggccaagggacaatggtcaccgtctcttcagctagc

SEQ ID NO: 480 - DNA, 389 bp, Artificial Sequence
  gnl|Fabrus|VH1-45_IGHD3-10*01_IGHJ4*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatattattactatggttcggggagttattataacgactactttgactactggggccaaggaaccctggtcaccgtctcctcagctagc

SEQ ID NO: 481 - DNA, 398 bp, Artificial Sequence
  gnl|Fabrus|VH1-45_IGHD3-16*01_IGHJ2*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatattattatgattacgtttgggggagttatgcttatacctactggtacttcgatctctggggccgtggcaccctggtcactgtctcctcagctagc

SEQ ID NO: 482 - DNA, 377 bp, Artificial Sequence
  gnl|Fabrus|VH1-45_IGHD4-23*01_IGHJ4*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatatgactacggtggtaactccgactactttgactactggggccaaggaaccctggtcaccgtctcctcagctagc

SEQ ID NO: 483 - DNA, 377 bp, Artificial Sequence
  gnl|Fabrus|VH1-45_IGHD5-24*01_IGHJ4*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatgtagagatggctacaattacgactactttgactactggggccaaggaaccctggtcaccgtctcctcagctagc

SEQ ID NO: 484 - DNA, 380 bp, Artificial Sequence
  gnl|Fabrus|VH1-45_IGHD6-19*01_IGHJ4*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatatgggtatagcagtggctggtacgactactttgactactggggccaaggaaccctggtcaccgtctcctcagctagc

SEQ ID NO: 485 - DNA, 383 bp, Artificial Sequence
  gnl|Fabrus|VH1-45_IGHD7-27*01_IGHJ6*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatctaactggggagattactactactactacggtatggacgtctgggggcaagggaccacggtcaccgtctcctcagctagc

SEQ ID NO: 486 - DNA, 377 bp, Artificial Sequence
  gnl|Fabrus|VH1-46_IGHD1-26*01_IGHJ4*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagggtatagtgggagctactacgactactttgactactggggccaaggaaccctggtcaccgtctcctcagctagc

SEQ ID NO: 487 - DNA, 392 bp, Artificial Sequence
  gnl|Fabrus|VH1-46_IGHD2-15*01_IGHJ2*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaaggatattgtagtggtggtagctgctactcctactggtacttcgatctctggggccgtggcaccctggtcactgtctcctcagctagc

SEQ ID NO: 488 - DNA, 389 bp, Artificial Sequence
  gnl|Fabrus|VH1-46_IGHD3-10*01_IGHJ4*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagagtattactatggttcggggagttattataacgactactttgactactggggccaaggaaccctggtcaccgtctcctcagctagc

SEQ ID NO: 489 - DNA, 374 bp, Artificial Sequence
  gnl|Fabrus|VH1-46_IGHD4-17*01_IGHJ4*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagatgactacggtgactacgactactttgactactggggccaaggaaccctggtcaccgtctcctcagctagc

SEQ ID NO: 490 - DNA, 377 bp, Artificial Sequence
  gnl|Fabrus|VH1-46_IGHD5-18*01_IGHJ4*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaggtggatacagctatggttacgactactttgactactggggccaaggaaccctggtcaccgtctcctcagctagc

SEQ ID NO: 491 - DNA, 380 bp, Artificial Sequence
  gnl|Fabrus|VH1-46_IGHD6-13*01_IGHJ4*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggggtatagcagcagctggtacgactactttgactactggggccaaggaaccctggtcaccgtctcctcagctagc

SEQ ID NO: 492 - DNA, 380 bp, Artificial Sequence
  gnl|Fabrus|VH1-46_IGHD6-6*01_IGHJ1*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggagtatagcagctcgtccgctgaatacttccagcactggggccagggcaccctggtcaccgtctcctcagctagc

SEQ ID NO: 493 - DNA, 371 bp, Artificial Sequence
  gnl|Fabrus|VH1-46_IGHD7-27*01_IGHJ2*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagctaactggggatactggtacttcgatctctggggccgtggcaccctggtcactgtctcctcagctagc

SEQ ID NO: 494 - DNA, 377 bp, Artificial Sequence
  gnl|Fabrus|VH1-58_IGHD1-26*01_IGHJ4*01
ccatggcacaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagggtatagtgggagctactacgactactttgactactggggccaaggaaccctggtcaccgtctcctcagctagc

SEQ ID NO: 495 - DNA, 392 bp, Artificial Sequence
  gnl|Fabrus|VH1-58_IGHD2-15*01_IGHJ2*01
ccatggcacaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagaaggatattgtagtggtggtagctgctactcctactggtacttcgatctctggggccgtggcaccctggtcactgtctcctcagctagc

SEQ ID NO: 496 - DNA, 404 bp, Artificial Sequence
  gnl|Fabrus|VH1-58_IGHD3-10*01_IGHJ6*01
ccatggcacaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagagtattactatggttcggggagttattataacgattactactactactacggtatggacgtctgggggcaagggaccacggtcaccgtctcctcagctagc

SEQ ID NO: 497 - DNA, 374 bp, Artificial Sequence
  gnl|Fabrus|VH1-58_IGHD4-17*01_IGHJ4*01
ccatggcacaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagatgactacggtgactacgactactttgactactggggccaaggaaccctggtcaccgtctcctcagctagc

SEQ ID NO: 498 - DNA, 377 bp, Artificial Sequence
  gnl|Fabrus|VH1-58_IGHD5-18*01_IGHJ4*01
ccatggcacaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcaggtggatacagctatggttacgactactttgactactggggccaaggaaccctggtcaccgtctcctcagctagc

SEQ ID NO: 499 - DNA, 380 bp, Artificial Sequence
  gnl|Fabrus|VH1-58_IGHD6-6*01_IGHJ1*01
ccatggcacaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagaggagtatagcagctcgtccgctgaatacttccagcactggggccagggcaccctggtcaccgtctcctcagctagc

SEQ ID NO: 500 - DNA, 371 bp, Artificial Sequence
  gnl|Fabrus|VH1-58_IGHD7-27*01_IGHJ5*01
ccatggcacaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagctaactggggagacaactggttcgactcctggggccaaggaaccctggtcaccgtctcctcagctagc

SEQ ID NO: 501 - DNA, 389 bp, Artificial Sequence
  gnl|Fabrus|VH1-69_IGHD1-1*01_IGHJ6*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagggtacaactggaacgacgattactactactactacggtatggacgtctgggggcaagggaccacggtcaccgtctcctcagctagc

SEQ ID NO: 502 - DNA, 374 bp, Artificial Sequence
  gnl|Fabrus|VH1-69_IGHD1-14*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagggtataaccggaaccacgactactttgactactggggccaaggaaccctggtcaccgtctcctcagctagc

SEQ ID NO: 503 - DNA, 389 bp, Artificial Sequence
  gnl|Fabrus|VH1-69_IGHD2-2*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagaaggatattgtagtagtaccagctgctatgccgactactttgactactggggccaaggaaccctggtcaccgtctcctcagctagc

SEQ ID NO: 504 - DNA, 404 bp, Artificial Sequence
  gnl|Fabrus|VH1-69_IGHD2-8*01_IGHJ6*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagaaggatattgtactaatggtgtatgctataccgattactactactactacggtatggacgtctgggggcaagggaccacggtcaccgtctcctcagctagc

SEQ ID NO: 505 - DNA, 395 bp, Artificial Sequence
  gnl|Fabrus|VH1-69_IGHD3-16*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagagtattatgattacgtttgggggagttatgcttataccgactactttgactactggggccaaggaaccctggtcaccgtctcctcagctagc

SEQ ID NO: 506 - DNA, 389 bp, Artificial Sequence
  gnl|Fabrus|VH1-69_IGHD3-3*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagagtattacgatttttggagtggttattataccgactactttgactactggggccaaggaaccctggtcaccgtctcctcagctagc

SEQ ID NO: 507 - DNA, 404 bp, Artificial Sequence
  gnl|Fabrus|VH1-69_IGHD3-9*01_IGHJ6*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagagtattacgatattttgactggttattataacgattactactactactacggtatggacgtctgggggcaagggaccacggtcaccgtctcctcagctagc

SEQ ID NO: 508 - DNA, 374 bp, Artificial Sequence
  gnl|Fabrus|VH1-69_IGHD4-17*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagatgactacggtgactacgactactttgactactggggccaaggaaccctggtcaccgtctcctcagctagc

SEQ ID NO: 509 - DNA, 380 bp, Artificial Sequence
  gnl|Fabrus|VH1-69_IGHD5-12*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagaggtggatatagtggctacgattacgactactttgactactggggccaaggaaccctggtcaccgtctcctcagctagc

SEQ ID NO: 510 - DNA, 392 bp, Artificial Sequence
  gnl|Fabrus|VH1-69_IGHD5-24*01_IGHJ6*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagaggtagagatggctacaattacgattactactactactacggtatggacgtctgggggcaagggaccacggtcaccgtctcctcagctagc

SEQ ID NO: 511 - DNA, 380 bp, Artificial Sequence
  gnl|Fabrus|VH1-69_IGHD6-19*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagaggggtatagcagtggctggtacgactactttgactactggggccaaggaaccctggtcaccgtctcctcagctagc

SEQ ID NO: 512 - DNA, 380 bp, Artificial Sequence
  gnl|Fabrus|VH1-69_IGHD6-6*01_IGHJ1*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagaggagtatagcagctcgtccgctgaatacttccagcactggggccagggcaccctggtcaccgtctcctcagctagc

SEQ ID NO: 513 - DNA, 368 bp, Artificial Sequence
  gnl|Fabrus|VH1-69_IGHD7-27*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagagctaactggggactactttgactactggggccaaggaaccctggtcaccgtctcctcagctagc

SEQ ID NO: 514 - DNA, 377 bp, Artificial Sequence
  gnl|Fabrus|VH1-8_IGHD1-26*01_IGHJ4*01
ccatggcacaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagagggtatagtgggagctactacgactactttgactactggggccaaggaaccctggtcaccgtctcctcagctagc

SEQ ID NO: 515 - DNA, 404 bp, Artificial Sequence
  gnl|Fabrus|VH1-8_IGHD2-15*01_IGHJ6*01
ccatggcacaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggaggatattgtagtggtggtagctgctactccgattactactactactacggtatggacgtctgggggcaagggaccacggtcaccgtctcctcagctagc

SEQ ID NO: 516 - DNA, 404 bp, Artificial Sequence
  gnl|Fabrus|VH1-8_IGHD2-2*01_IGHJ6*01
ccatggcacaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggaggatattgtagtagtaccagctgctatgccgattactactactactacggtatggacgtctgggggcaagggaccacggtcaccgtctcctcagctagc

SEQ ID NO: 517 - DNA, 389 bp, Artificial Sequence
  gnl|Fabrus|VH1-8_IGHD3-10*01_IGHJ4*01
ccatggcacaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagagggtattactatggttcggggagttattataacgactactttgactactggggccaaggaaccctggtcaccgtctcctcagctagc

SEQ ID NO: 518 - DNA, 374 bp, Artificial Sequence
  gnl|Fabrus|VH1-8_IGHD4-17*01_IGHJ4*01
ccatggcacaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggtgactacggtgactacgactactttgactactggggccaaggaaccctggtcaccgtctcctcagctagc

SEQ ID NO: 519 - DNA, 377 bp, Artificial Sequence
  gnl|Fabrus|VH1-8_IGHD5-5*01_IGHJ4*01
ccatggcacaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggtggatacagctatggttacgactactttgactactggggccaaggaaccctggtcaccgtctcctcagctagc

SEQ ID NO: 520 - DNA, 368 bp, Artificial Sequence
  gnl|Fabrus|VH1-8_IGHD7-27*01_IGHJ4*01
ccatggcacaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagagctaactggggagactactttgactactggggccaaggaaccctggtcaccgtctcctcagctagc

SEQ ID NO: 521 - DNA, 380 bp, Artificial Sequence
  gnl|Fabrus|VH2-26_IGHD1-20*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacggtataactggaacgacgactactttgactactggggccaaggaaccctggtcaccgtctcctcagctagc

SEQ ID NO: 522 - DNA, 398 bp, Artificial Sequence
  gnl|Fabrus|VH2-26_IGHD2-15*01_IGHJ2*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacgaggatattgtagtggtggtagctgctactcctactggtacttcgatctctggggccgtggcaccctggtcactgtctcctcagctagc

SEQ ID NO: 523 - DNA, 395 bp, Artificial Sequence
  gnl|Fabrus|VH2-26_IGHD2-2*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacgaggatattgtagtagtaccagctgctatgccgactactttgactactggggccaaggaaccctggtcaccgtctcctcagctagc

SEQ ID NO: 524 - DNA, 395 bp, Artificial Sequence
  gnl|Fabrus|VH2-26_IGHD3-10*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacggtattactatggttcggggagttattataacgactactttgactactggggccaaggaaccctggtcaccgtctcctcagctagc

SEQ ID NO: 525 - DNA, 410 bp, Artificial Sequence
  gnl|Fabrus|VH2-26_IGHD3-9*01_IGHJ6*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacggtattacgatattttgactggttattataacgattactactactactacggtatggacgtctgggggcaagggaccacggtcaccgtctcctcagctagc

SEQ ID NO: 526 - DNA, 380 bp, Artificial Sequence
  gnl|Fabrus|VH2-26_IGHD4-11*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacgtgactacagtaactacgactactttgactactggggccaaggaaccctggtcaccgtctcctcagctagc

SEQ ID NO: 527 - DNA, 386 bp, Artificial Sequence
  gnl|Fabrus|VH2-26_IGHD5-12*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacgtggatatagtggctacgattacgactactttgactactggggccaaggaaccctggtcaccgtctcctcagctagc

SEQ ID NO: 528 - DNA, 383 bp, Artificial Sequence
  gnl|Fabrus|VH2-26_IGHD5-18*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacgtggatacagctatggttacgactactttgactactggggccaaggaaccctggtcaccgtctcctcagctagc

SEQ ID NO: 529 - DNA, 383 bp, Artificial Sequence
  gnl|Fabrus|VH2-26_IGHD6-13*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatagggtatagcagcagctggtacgactactttgactactggggccaaggaaccctggtcaccgtctcctcagctagc

SEQ ID NO: 530 - DNA, 371 bp, Artificial Sequence
  gnl|Fabrus|VH2-26_IGHD7-27*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatactaactggggactactttgactactggggccaaggaaccctggtcaccgtctcctcagctagc

SEQ ID NO: 531 - DNA, 374 bp, Artificial Sequence
  gnl|Fabrus|VH2-26_IGHD7-27*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacctaactggggagactactttgactactggggccaaggaaccctggtcaccgtctcctcagctagc

SEQ ID NO: 532 - DNA, 383 bp, Artificial Sequence
  gnl|Fabrus|VH2-5_IGHD1-1*01_IGHJ5*01
ccatggcacagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacggtacaactggaacgacgacaactggttcgactcctggggccaaggaaccctggtcaccgtctcctcagctagc

SEQ ID NO: 533 - DNA, 410 bp, Artificial Sequence
  gnl|Fabrus|VH2-5_IGHD2-15*01_IGHJ6*01
ccatggcacagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacgaggatattgtagtggtggtagctgctactccgattactactactactacggtatggacgtctgggggcaagggaccacggtcaccgtctcctcagctagc

SEQ ID NO: 534 - DNA, 401 bp, Artificial Sequence
  gnl|Fabrus|VH2-5_IGHD3-16*01_IGHJ4*01
ccatggcacagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacggtattatgattacgtttgggggagttatgcttataccgactactttgactactggggccaaggaaccctggtcaccgtctcctcagctagc

SEQ ID NO: 535 - DNA, 410 bp, Artificial Sequence
  gnl|Fabrus|VH2-5_IGHD3-9*01_IGHJ6*01
ccatggcacagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacggtattacgatattttgactggttattataacgattactactactactacggtatggacgtctgggggcaagggaccacggtcaccgtctcctcagctagc

SEQ ID NO: 536 - DNA, 386 bp, Artificial Sequence
  gnl|Fabrus|VH2-5_IGHD5-12*01_IGHJ4*01
ccatggcacagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacgtggatatagtggctacgattacgactactttgactactggggccaaggaaccctggtcaccgtctcctcagctagc

SEQ ID NO: 537 - DNA, 383 bp, Artificial Sequence
  gnl|Fabrus|VH2-5_IGHD6-13*01_IGHJ4*01
ccatggcacagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagagggtatagcagcagctggtacgactactttgactactggggccaaggaaccctggtcaccgtctcctcagctagc

SEQ ID NO: 538 - DNA, 377 bp, Artificial Sequence
  gnl|Fabrus|VH2-5_IGHD7-27*01_IGHJ2*01
ccatggcacagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacctaactggggatactggtacttcgatctctggggccgtggcaccctggtcactgtctcctcagctagc

SEQ ID NO: 539 - DNA, 383 bp, Artificial Sequence
  gnl|Fabrus|VH2-70_IGHD1-1*01_IGHJ2*01
ccatggcacaggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacggtacaactggaacgactactggtacttcgatctctggggccgtggcaccctggtcactgtctcctcagctagc

SEQ ID NO: 540 - DNA, 398 bp, Artificial Sequence
  gnl|Fabrus|VH2-70_IGHD2-15*01_IGHJ2*01
ccatggcacaggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacgaggatattgtagtggtggtagctgctactcctactggtacttcgatctctggggccgtggcaccctggtcactgtctcctcagctagc

SEQ ID NO: 541 - DNA, 395 bp, Artificial Sequence
  gnl|Fabrus|VH2-70_IGHD3-22*01_IGHJ4*01
ccatggcacaggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacggtattactatgatagtagtggttattactacgactactttgactactggggccaaggaaccctggtcaccgtctcctcagctagc

SEQ ID NO: 542 - DNA, 410 bp, Artificial Sequence
  gnl|Fabrus|VH2-70_IGHD3-9*01_IGHJ6*01
ccatggcacaggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacggtattacgatattttgactggttattataacgattactactactactacggtatggacgtctgggggcaagggaccacggtcaccgtctcctcagctagc

SEQ ID NO: 543 - DNA, 386 bp, Artificial Sequence
  gnl|Fabrus|VH2-70_IGHD5-12*01_IGHJ4*01
ccatggcacaggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacgtggatatagtggctacgattacgactactttgactactggggccaaggaaccctggtcaccgtctcctcagctagc

SEQ ID NO: 544 - DNA, 377 bp, Artificial Sequence
  gnl|Fabrus|VH2-70_IGHD7-27*01_IGHJ2*01
ccatggcacaggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacctaactggggatactggtacttcgatctctggggccgtggcaccctggtcactgtctcctcagctagc

SEQ ID NO: 545 - DNA, 377 bp, Artificial Sequence
  gnl|Fabrus|VH3-11_IGHD1-26*01_IGHJ4*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagggtatagtgggagctactacgactactttgactactggggccaaggaaccctggtcaccgtctcctcagctagc

SEQ ID NO: 546 - DNA, 404 bp, Artificial Sequence
  gnl|Fabrus|VH3-11_IGHD2-2*01_IGHJ6*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagaaggatattgtagtagtaccagctgctatgccgattactactactactacggtatggacgtctgggggcaagggaccacggtcaccgtctcctcagctagc

SEQ ID NO: 547 - DNA, 395 bp, Artificial Sequence
  gnl|Fabrus|VH3-11_IGHD3-16*01_IGHJ4*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagagtattatgattacgtttgggggagttatgcttataccgactactttgactactggggccaaggaaccctggtcaccgtctcctcagctagc

SEQ ID NO: 548 - DNA, 404 bp, Artificial Sequence
  gnl|Fabrus|VH3-11_IGHD3-9*01_IGHJ6*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagagtattacgatattttgactggttattataacgattactactactactacggtatggacgtctgggggcaagggaccacggtcaccgtctcctcagctagc

SEQ ID NO: 549 - DNA, 380 bp, Artificial Sequence
  gnl|Fabrus|VH3-11_IGHD4-23*01_IGHJ5*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagatgactacggtggtaactccgacaactggttcgactcctggggccaaggaaccctggtcaccgtctcctcagctagc

SEQ ID NO: 550 - DNA, 377 bp, Artificial Sequence
  gnl|Fabrus|VH3-11_IGHD5-18*01_IGHJ4*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagaggtggatacagctatggttacgactactttgactactggggccaaggaaccctggtcaccgtctcctcagctagc

SEQ ID NO: 551 - DNA, 395 bp, Artificial Sequence
  gnl|Fabrus|VH3-11_IGHD6-19*01_IGHJ6*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagaggggtatagcagtggctggtacgattactactactactacggtatggacgtctgggggcaagggaccacggtcaccgtctcctcagctagc

SEQ ID NO: 552 - DNA, 380 bp, Artificial Sequence
  gnl|Fabrus|VH3-11_IGHD6-6*01_IGHJ1*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagaggagtatagcagctcgtccgctgaatacttccagcactggggccagggcaccctggtcaccgtctcctcagctagc

SEQ ID NO: 553 - DNA, 368 bp, Artificial Sequence
  gnl|Fabrus|VH3-11_IGHD7-27*01_IGHJ4*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagagctaactggggactactttgactactggggccaaggaaccctggtcaccgtctcctcagctagc

SEQ ID NO: 554 - DNA, 374 bp, Artificial Sequence
  gnl|Fabrus|VH3-13_IGHD1-26*01_IGHJ4*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagggtatagtgggagctactacgactactttgactactggggccaaggaaccctggtcaccgtctcctcagctagc

SEQ ID NO: 555 - DNA, 389 bp, Artificial Sequence
  gnl|Fabrus|VH3-13_IGHD2-8*01_IGHJ5*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagaaggatattgtactaatggtgtatgctataccgacaactggttcgactcctggggccaaggaaccctggtcaccgtctcctcagctagc

SEQ ID NO: 556 - DNA, 389 bp, Artificial Sequence
  gnl|Fabrus|VH3-13_IGHD3-3*01_IGHJ1*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagagtattacgatttttggagtggttattataccgctgaatacttccagcactggggccagggcaccctggtcaccgtctcctcagctagc

SEQ ID NO: 557 - DNA, 401 bp, Artificial Sequence
  gnl|Fabrus|VH3-13_IGHD3-9*01_IGHJ6*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagagtattacgatattttgactggttattataacgattactactactactacggtatggacgtctgggggcaagggaccacggtcaccgtctcctcagctagc

SEQ ID NO: 558 - DNA, 377 bp, Artificial Sequence
  gnl|Fabrus|VH3-13_IGHD4-23*01_IGHJ5*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagatgactacggtggtaactccgacaactggttcgactcctggggccaaggaaccctggtcaccgtctcctcagctagc

SEQ ID NO: 559 - DNA, 374 bp, Artificial Sequence
  gnl|Fabrus|VH3-13_IGHD5-5*01_IGHJ4*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagaggtggatacagctatggttacgactactttgactactggggccaaggaaccctggtcaccgtctcctcagctagc

SEQ ID NO: 560 - DNA, 377 bp, Artificial Sequence
  gnl|Fabrus|VH3-13_IGHD6-6*01_IGHJ1*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagaggagtatagcagctcgtccgctgaatacttccagcactggggccagggcaccctggtcaccgtctcctcagctagc

SEQ ID NO: 561 - DNA, 368 bp, Artificial Sequence
  gnl|Fabrus|VH3-13_IGHD7-27*01_IGHJ5*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagctaactggggagacaactggttcgactcctggggccaaggaaccctggtcaccgtctcctcagctagc

SEQ ID NO: 562 - DNA, 383 bp, Artificial Sequence
  gnl|Fabrus|VH3-15_IGHD1-26*01_IGHJ4*01
ccatggcagaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagggtatagtgggagctactacgactactttgactactggggccaaggaaccctggtcaccgtctcctcagctagc

SEQ ID NO: 563 - DNA, 398 bp, Artificial Sequence
  gnl|Fabrus|VH3-15_IGHD2-15*01_IGHJ2*01
ccatggcagaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagaaggatattgtagtggtggtagctgctactcctactggtacttcgatctctggggccgtggcaccctggtcactgtctcctcagctagc

SEQ ID NO: 564 - DNA, 410 bp, Artificial Sequence
  gnl|Fabrus|VH3-15_IGHD2-15*01_IGHJ6*01
ccatggcagaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagaaggatattgtagtggtggtagctgctactccgattactactactactacggtatggacgtctgggggcaagggaccacggtcaccgtctcctcagctagc

SEQ ID NO: 565 - DNA, 395 bp, Artificial Sequence
  gnl|Fabrus|VH3-15_IGHD3-10*01_IGHJ4*01
ccatggcagaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagagtattactatggttcggggagttattataacgactactttgactactggggccaaggaaccctggtcaccgtctcctcagctagc

SEQ ID NO: 566 - DNA, 398 bp, Artificial Sequence
  gnl|Fabrus|VH3-15_IGHD3-9*01_IGHJ2*01
ccatggcagaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagagtattacgatattttgactggttattataactactggtacttcgatctctggggccgtggcaccctggtcactgtctcctcagctagc

SEQ ID NO: 567 - DNA, 386 bp, Artificial Sequence
  gnl|Fabrus|VH3-15_IGHD5-12*01_IGHJ4*01
ccatggcagaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacaggtggatatagtggctacgattacgactactttgactactggggccaaggaaccctggtcaccgtctcctcagctagc

SEQ ID NO: 568 - DNA, 386 bp, Artificial Sequence
  gnl|Fabrus|VH3-15_IGHD6-6*01_IGHJ1*01
ccatggcagaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagaggagtatagcagctcgtccgctgaatacttccagcactggggccagggcaccctggtcaccgtctcctcagctagc

SEQ ID NO: 569 - DNA, 377 bp, Artificial Sequence
  gnl|Fabrus|VH3-16_IGHD1-1*01_IGHJ1*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaggtacaactggaacgacgctgaatacttccagcactggggccagggcaccctggtcaccgtctcctcagctagc

SEQ ID NO: 570 - DNA, 389 bp, Artificial Sequence
  gnl|Fabrus|VH3-16_IGHD1-7*01_IGHJ6*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaggtataactggaactacgattactactactactacggtatggacgtctgggggcaagggaccacggtcaccgtctcctcagctagc

SEQ ID NO: 571 - DNA, 392 bp, Artificial Sequence
  gnl|Fabrus|VH3-16_IGHD2-15*01_IGHJ2*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaaaggatattgtagtggtggtagctgctactcctactggtacttcgatctctggggccgtggcaccctggtcactgtctcctcagctagc

SEQ ID NO: 572 - DNA, 392 bp, Artificial Sequence
  gnl|Fabrus|VH3-16_IGHD2-2*01_IGHJ2*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaaaggatattgtagtagtaccagctgctatgcctactggtacttcgatctctggggccgtggcaccctggtcactgtctcctcagctagc

SEQ ID NO: 573 - DNA, 389 bp, Artificial Sequence
  gnl|Fabrus|VH3-16_IGHD3-10*01_IGHJ4*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaagtattactatggttcggggagttattataacgactactttgactactggggccaaggaaccctggtcaccgtctcctcagctagc

SEQ ID NO: 574 - DNA, 377 bp, Artificial Sequence
  gnl|Fabrus|VH3-16_IGHD4-4*01_IGHJ2*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaatgactacagtaactactactggtacttcgatctctggggccgtggcaccctggtcactgtctcctcagctagc

SEQ ID NO: 575 - DNA, 377 bp, Artificial Sequence
  gnl|Fabrus|VH3-16_IGHD5-24*01_IGHJ4*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaagtagagatggctacaattacgactactttgactactggggccaaggaaccctggtcaccgtctcctcagctagc

SEQ ID NO: 576 - DNA, 380 bp, Artificial Sequence
  gnl|Fabrus|VH3-16_IGHD6-13*01_IGHJ4*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaaggggtatagcagcagctggtacgactactttgactactggggccaaggaaccctggtcaccgtctcctcagctagc

SEQ ID NO: 577 - DNA, 371 bp, Artificial Sequence
  gnl|Fabrus|VH3-16_IGHD7-27*01_IGHJ2*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaactaactggggatactggtacttcgatctctggggccgtggcaccctggtcactgtctcctcagctagc

SEQ ID NO: 578 - DNA, 374 bp, Artificial Sequence
  gnl|Fabrus|VH3-20_IGHD1-14*01_IGHJ4*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagggtataaccggaaccacgactactttgactactggggccaaggaaccctggtcaccgtctcctcagctagc

SEQ ID NO: 579 - DNA, 392 bp, Artificial Sequence
  gnl|Fabrus|VH3-20_IGHD2-15*01_IGHJ2*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagaaggatattgtagtggtggtagctgctactcctactggtacttcgatctctggggccgtggcaccctggtcactgtctcctcagctagc

SEQ ID NO: 580 - DNA, 386 bp, Artificial Sequence
  gnl|Fabrus|VH3-20_IGHD2-8*01_IGHJ4*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagaggatattgtactaatggtgtatgctatacactactttgactactggggccaaggaaccctggtcaccgtctcctcagctagc

SEQ ID NO: 581 - DNA, 389 bp, Artificial Sequence
  gnl|Fabrus|VH3-20_IGHD3-10*01_IGHJ4*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagagtattactatggttcggggagttattataacgactactttgactactggggccaaggaaccctggtcaccgtctcctcagctagc

SEQ ID NO: 582 - DNA, 404 bp, Artificial Sequence
  gnl|Fabrus|VH3-20_IGHD3-9*01_IGHJ6*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagagtattacgatattttgactggttattataacgattactactactactacggtatggacgtctgggggcaagggaccacggtcaccgtctcctcagctagc

SEQ ID NO: 583 - DNA, 377 bp, Artificial Sequence
  gnl|Fabrus|VH3-20_IGHD4-23*01_IGHJ4*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagatgactacggtggtaactccgactactttgactactggggccaaggaaccctggtcaccgtctcctcagctagc

SEQ ID NO: 584 - DNA, 380 bp, Artificial Sequence
  gnl|Fabrus|VH3-20_IGHD5-12*01_IGHJ4*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagaggtggatatagtggctacgattacgactactttgactactggggccaaggaaccctggtcaccgtctcctcagctagc

SEQ ID NO: 585 - DNA, 380 bp, Artificial Sequence
  gnl|Fabrus|VH3-20_IGHD6-13*01_IGHJ4*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagaggggtatagcagcagctggtacgactactttgactactggggccaaggaaccctggtcaccgtctcctcagctagc

SEQ ID NO: 586 - DNA, 371 bp, Artificial Sequence
  gnl|Fabrus|VH3-20_IGHD7-27*01_IGHJ2*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagctaactggggatactggtacttcgatctctggggccgtggcaccctggtcactgtctcctcagctagc

SEQ ID NO: 587 - DNA, 377 bp, Artificial Sequence
  gnl|Fabrus|VH3-21_IGHD1-26*01_IGHJ4*01
ccatggcagaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagggtatagtgggagctactacgactactttgactactggggccaaggaaccctggtcaccgtctcctcagctagc

SEQ ID NO: 588 - DNA, 392 bp, Artificial Sequence
  gnl|Fabrus|VH3-21_IGHD2-2*01_IGHJ5*01
ccatggcagaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagaaggatattgtagtagtaccagctgctatgccgacaactggttcgactcctggggccaaggaaccctggtcaccgtctcctcagctagc

SEQ ID NO: 589 - DNA, 389 bp, Artificial Sequence
  gnl|Fabrus|VH3-21_IGHD3-22*01_IGHJ4*01
ccatggcagaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagagtattactatgatagtagtggttattactacgactactttgactactggggccaaggaaccctggtcaccgtctcctcagctagc

SEQ ID NO: 590 - DNA, 380 bp, Artificial Sequence
  gnl|Fabrus|VH3-21_IGHD4-23*01_IGHJ5*01
ccatggcagaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagatgactacggtggtaactccgacaactggttcgactcctggggccaaggaaccctggtcaccgtctcctcagctagc

SEQ ID NO: 591 - DNA, 380 bp, Artificial Sequence
  gnl|Fabrus|VH3-21_IGHD5-24*01_IGHJ5*01
ccatggcagaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagaggtagagatggctacaattacgacaactggttcgactcctggggccaaggaaccctggtcaccgtctcctcagctagc

SEQ ID NO: 592 - DNA, 383 bp, Artificial Sequence
  gnl|Fabrus|VH3-21_IGHD6-19*01_IGHJ1*01
ccatggcagaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagaggggtatagcagtggctggtacgctgaatacttccagcactggggccagggcaccctggtcaccgtctcctcagctagc

SEQ ID NO: 593 - DNA, 368 bp, Artificial Sequence
  gnl|Fabrus|VH3-21_IGHD7-27*01_IGHJ4*01
ccatggcagaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagctaactggggagactactttgactactggggccaaggaaccctggtcaccgtctcctcagctagc

SEQ ID NO: 594 - DNA, 377 bp, Artificial Sequence
  gnl|Fabrus|VH3-23_IGHD1-1*01_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagggtacaactggaacgacgctgaatacttccagcactggggccagggcaccctggtcaccgtctcctcagctagc

SEQ ID NO: 595 - DNA, 374 bp, Artificial Sequence
  gnl|Fabrus|VH3-23_IGHD1-1*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagggtacaactggaacgaactactttgactactggggccaaggaaccctggtcaccgtctcctcagctagc

SEQ ID NO: 596 - DNA, 374 bp, Artificial Sequence
  gnl|Fabrus|VH3-23_IGHD1-20*01_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagggtataactggaacgacgatgcttttgatgtctggggccaagggacaatggtcaccgtctcttcagctagc

SEQ ID NO: 597 - DNA, 377 bp, Artificial Sequence
  gnl|Fabrus|VH3-23_IGHD1-26*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagggtatagtgggagctactacgactactttgactactggggccaaggaaccctggtcaccgtctcctcagctagc

SEQ ID NO: 598 - DNA, 389 bp, Artificial Sequence
  gnl|Fabrus|VH3-23_IGHD2-15*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaaggatattgtagtggtggtagctgctactccgactactttgactactggggccaaggaaccctggtcaccgtctcctcagctagc

SEQ ID NO: 599 - DNA, 389 bp, Artificial Sequence
  gnl|Fabrus|VH3-23_IGHD2-21*01_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaagcatattgtggtggtgattgctattccgctgaatacttccagcactggggccagggcaccctggtcaccgtctcctcagctagc

SEQ ID NO: 600 - DNA, 389 bp, Artificial Sequence
  gnl|Fabrus|VH3-23_IGHD3-10*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagc

SEQ ID NO: 601 - DNA, 395 bp, Artificial Sequence
  gnl|Fabrus|VH3-23_IGHD3-16*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattatgattacgtttgggggagttatgcttataccgactactttgactactggggccaaggaaccctggtcaccgtctcctcagctagc

SEQ ID NO: 602 - DNA, 389 bp, Artificial Sequence
  gnl|Fabrus|VH3-23_IGHD3-22*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatgatagtagtggttattactacgactactttgactactggggccaaggaaccctggtcaccgtctcctcagctagc

SEQ ID NO: 603 - DNA, 392 bp, Artificial Sequence
  gnl|Fabrus|VH3-23_IGHD3-3*01_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattacgatttttggagtggttattataccgacaactggttcgactcctggggccaaggaaccctggtcaccgtctcctcagctagc

SEQ ID NO: 604 - DNA, 374 bp, Artificial Sequence
  gnl|Fabrus|VH3-23_IGHD4-11*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatgactacagtaactacgactactttgactactggggccaaggaaccctggtcaccgtctcctcagctagc

SEQ ID NO: 605 - DNA, 380 bp, Artificial Sequence
  gnl|Fabrus|VH3-23_IGHD4-23*01_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatgactacggtggtaactcctactggtacttcgatctctggggccgtggcaccctggtcactgtctcctcagctagc

SEQ ID NO: 606 - DNA, 380 bp, Artificial Sequence
  gnl|Fabrus|VH3-23_IGHD5-12*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaggtggatatagtggctacgattacgactactttgactactggggccaaggaaccctggtcaccgtctcctcagctagc

SEQ ID NO: 607 - DNA, 380 bp, Artificial Sequence
  gnl|Fabrus|VH3-23_IGHD5-24*01_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaggtagagatggctacaattacgctgaatacttccagcactggggccagggcaccctggtcaccgtctcctcagctagc

SEQ ID NO: 608 - DNA, 377 bp, Artificial Sequence
  gnl|Fabrus|VH3-23_IGHD5-5*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaggtggatacagctatggttacgactactttgactactggggccaaggaaccctggtcaccgtctcctcagctagc

SEQ ID NO: 609 - DNA, 380 bp, Artificial Sequence
  gnl|Fabrus|VH3-23_IGHD6-13*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaggggtatagcagcagctggtacgactactttgactactggggccaaggaaccctggtcaccgtctcctcagctagc

SEQ ID NO: 610 - DNA, 380 bp, Artificial Sequence
  gnl|Fabrus|VH3-23_IGHD6-25*01_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaggggtatagcagcggctactactggtacttcgatctctggggccgtggcaccctggtcactgtctcctcagctagc

SEQ ID NO: 611 - DNA, 380 bp, Artificial Sequence
  gnl|Fabrus|VH3-23_IGHD6-6*01_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaggagtatagcagctcgtccgctgaatacttccagcactggggccagggcaccctggtcaccgtctcctcagctagc

SEQ ID NO: 612 - DNA, 368 bp, Artificial Sequence
  gnl|Fabrus|VH3-23_IGHD7-27*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagctaactggggagactactttgactactggggccaaggaaccctggtcaccgtctcctcagctagc

SEQ ID NO: 613 - DNA, 383 bp, Artificial Sequence
  gnl|Fabrus|VH3-23_IGHD7-27*01_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagctaactggggagattactactactactacggtatggacgtctgggggcaagggaccacggtcaccgtctcctcagctagc

SEQ ID NO: 614 - DNA, 389 bp, Artificial Sequence
  gnl|Fabrus|VH3-30_IGHD1-1*01_IGHJ6*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagggtacaactggaacgacgattactactactactacggtatggacgtctgggggcaagggaccacggtcaccgtctcctcagctagc

SEQ ID NO: 615 - DNA, 380 bp, Artificial Sequence
  gnl|Fabrus|VH3-30_IGHD1-26*01_IGHJ1*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagggtatagtgggagctactacgctgaatacttccagcactggggccagggcaccctggtcaccgtctcctcagctagc

SEQ ID NO: 616 - DNA, 377 bp, Artificial Sequence
  gnl|Fabrus|VH3-30_IGHD1-26*01_IGHJ4*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagggtatagtgggagctactacgactactttgactactggggccaaggaaccctggtcaccgtctcctcagctagc

SEQ ID NO: 617 - DNA, 392 bp, Artificial Sequence
  gnl|Fabrus|VH3-30_IGHD2-15*01_IGHJ2*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagaaggatattgtagtggtggtagctgctactcctactggtacttcgatctctggggccgtggcaccctggtcactgtctcctcagctagc

SEQ ID NO: 618 - DNA, 404 bp, Artificial Sequence
  gnl|Fabrus|VH3-30_IGHD2-2*01_IGHJ6*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagaaggatattgtagtagtaccagctgctatgccgattactactactactacggtatggacgtctgggggcaagggaccacggtcaccgtctcctcagctagc

SEQ ID NO: 619 - DNA, 392 bp, Artificial Sequence
  gnl|Fabrus|VH3-30_IGHD3-10*01_IGHJ1*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagaggtattactatggttcggggagttattataacggctgaatacttccagcactggggccagggcaccctggtcaccgtctcctcagctagc

SEQ ID NO: 620 - DNA, 410 bp, Artificial Sequence
  gnl|Fabrus|VH3-30_IGHD3-16*01_IGHJ6*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagagtattatgattacgtttgggggagttatgcttataccgattactactactactacggtatggacgtctgggggcaagggaccacggtcaccgtctcctcagctagc

SEQ ID NO: 621 - DNA, 374 bp, Artificial Sequence
  gnl|Fabrus|VH3-30_IGHD4-17*01_IGHJ4*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagatgactacggtgactacgactactttgactactggggccaaggaaccctggtcaccgtctcctcagctagc

SEQ ID NO: 622 - DNA, 380 bp, Artificial Sequence
  gnl|Fabrus|VH3-30_IGHD5-12*01_IGHJ4*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagaggtggatatagtggctacgattacgactactttgactactggggccaaggaaccctggtcaccgtctcctcagctagc

SEQ ID NO: 623 - DNA, 380 bp, Artificial Sequence
  gnl|Fabrus|VH3-30_IGHD5-18*01_IGHJ1*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagagtggatacagctatggttagctgaatacttccagcactggggccagggcaccctggtcaccgtctcctcagctagc

SEQ ID NO: 624 - DNA, 380 bp, Artificial Sequence
  gnl|Fabrus|VH3-30_IGHD6-13*01_IGHJ4*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagaggggtatagcagcagctggtacgactactttgactactggggccaaggaaccctggtcaccgtctcctcagctagc

SEQ ID NO: 625 - DNA, 380 bp, Artificial Sequence
  gnl|Fabrus|VH3-30_IGHD6-6*01_IGHJ1*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagaggagtatagcagctcgtccgctgaatacttccagcactggggccagggcaccctggtcaccgtctcctcagctagc

SEQ ID NO: 626 - DNA, 377 bp, Artificial Sequence
  gnl|Fabrus|VH3-35_IGHD1-1*01_IGHJ2*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaggtacaactggaacgactactggtacttcgatctctggggccgtggcaccctggtcactgtctcctcagctagc

SEQ ID NO: 627 - DNA, 389 bp, Artificial Sequence
  gnl|Fabrus|VH3-35_IGHD1-20*01_IGHJ6*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaggtataactggaacgacgattactactactactacggtatggacgtctgggggcaagggaccacggtcaccgtctcctcagctagc

SEQ ID NO: 628 - DNA, 392 bp, Artificial Sequence
  gnl|Fabrus|VH3-35_IGHD2-15*01_IGHJ2*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaaaggatattgtagtggtggtagctgctactcctactggtacttcgatctctggggccgtggcaccctggtcactgtctcctcagctagc

SEQ ID NO: 629 - DNA, 401 bp, Artificial Sequence
  gnl|Fabrus|VH3-35_IGHD2-21*01_IGHJ6*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaaagcatattgtggtggtgattgctattccgattactactactactacggtatggacgtctgggggcaagggaccacggtcaccgtctcctcagctagc

SEQ ID NO: 630 - DNA, 389 bp, Artificial Sequence
  gnl|Fabrus|VH3-35_IGHD3-10*01_IGHJ4*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaagtattactatggttcggggagttattataacgactactttgactactggggccaaggaaccctggtcaccgtctcctcagctagc

SEQ ID NO: 631 - DNA, 404 bp, Artificial Sequence
  gnl|Fabrus|VH3-35_IGHD3-9*01_IGHJ6*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaagtattacgatattttgactggttattataacgattactactactactacggtatggacgtctgggggcaagggaccacggtcaccgtctcctcagctagc

SEQ ID NO: 632 - DNA, 380 bp, Artificial Sequence
  gnl|Fabrus|VH3-35_IGHD5-12*01_IGHJ4*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaagtggatatagtggctacgattacgactactttgactactggggccaaggaaccctggtcaccgtctcctcagctagc

SEQ ID NO: 633 - DNA, 380 bp, Artificial Sequence
  gnl|Fabrus|VH3-35_IGHD6-13*01_IGHJ4*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaaggggtatagcagcagctggtacgactactttgactactggggccaaggaaccctggtcaccgtctcctcagctagc

SEQ ID NO: 634 - DNA, 371 bp, Artificial Sequence
  gnl|Fabrus|VH3-35_IGHD7-27*01_IGHJ1*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaactaactggggagctgaatacttccagcactggggccagggcaccctggtcaccgtctcctcagctagc

SEQ ID NO: 635 - DNA, 371 bp, Artificial Sequence
  gnl|Fabrus|VH3-38_IGHD1-14*01_IGHJ5*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatggtataaccggaaccacgacaactggttcgactcctggggccaaggaaccctggtcaccgtctcctcagctagc

SEQ ID NO: 636 - DNA, 383 bp, Artificial Sequence
  gnl|Fabrus|VH3-38_IGHD1-20*01_IGHJ6*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatggtataactggaacgacgattactactactactacggtatggacgtctgggggcaagggaccacggtcaccgtctcctcagctagc

SEQ ID NO: 637 - DNA, 398 bp, Artificial Sequence
  gnl|Fabrus|VH3-38_IGHD2-15*01_IGHJ6*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatggatattgtagtggtggtagctgctactccgattactactactactacggtatggacgtctgggggcaagggaccacggtcaccgtctcctcagctagc

SEQ ID NO: 638 - DNA, 386 bp, Artificial Sequence
  gnl|Fabrus|VH3-38_IGHD2-2*01_IGHJ1*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatggatattgtagtagtaccagctgctatgccgctgaatacttccagcactggggccagggcaccctggtcaccgtctcctcagctagc

SEQ ID NO: 639 - DNA, 383 bp, Artificial Sequence
  gnl|Fabrus|VH3-38_IGHD3-10*01_IGHJ4*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatattattactatggttcggggagttattataacgactactttgactactggggccaaggaaccctggtcaccgtctcctcagctagc

SEQ ID NO: 640 - DNA, 392 bp, Artificial Sequence
  gnl|Fabrus|VH3-38_IGHD3-16*01_IGHJ1*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatattattatgattacgtttgggggagttatgcttataccgctgaatacttccagcactggggccagggcaccctggtcaccgtctcctcagctagc

SEQ ID NO: 641 - DNA, 371 bp, Artificial Sequence
  gnl|Fabrus|VH3-38_IGHD4-17*01_IGHJ2*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatgactacggtgactactactggtacttcgatctctggggccgtggcaccctggtcactgtctcctcagctagc

SEQ ID NO: 642 - DNA, 371 bp, Artificial Sequence
  gnl|Fabrus|VH3-38_IGHD5-24*01_IGHJ3*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatgtagagatggctacaattacgatgcttttgatgtctggggccaagggacaatggtcaccgtctcttcagctagc

SEQ ID NO: 643 - DNA, 374 bp, Artificial Sequence
  gnl|Fabrus|VH3-38_IGHD6-6*01_IGHJ1*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatgagtatagcagctcgtccgctgaatacttccagcactggggccagggcaccctggtcaccgtctcctcagctagc

SEQ ID NO: 644 - DNA, 377 bp, Artificial Sequence
  gnl|Fabrus|VH3-38_IGHD7-27*01_IGHJ6*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatctaactggggagattactactactactacggtatggacgtctgggggcaagggaccacggtcaccgtctcctcagctagc

SEQ ID NO: 645 - DNA, 383 bp, Artificial Sequence
  gnl|Fabrus|VH3-43_IGHD1-26*01_IGHJ5*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagataggtatagtgggagctactacgacaactggttcgactcctggggccaaggaaccctggtcaccgtctcctcagctagc

SEQ ID NO: 646 - DNA, 392 bp, Artificial Sequence
  gnl|Fabrus|VH3-43_IGHD1-7*01_IGHJ6*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagataggtataactggaactacgattactactactactacggtatggacgtctgggggcaagggaccacggtcaccgtctcctcagctagc

SEQ ID NO: 647 - DNA, 392 bp, Artificial Sequence
  gnl|Fabrus|VH3-43_IGHD2-2*01_IGHJ3*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatagaggatattgtagtagtaccagctgctatgccgatgcttttgatgtctggggccaagggacaatggtcaccgtctcttcagctagc

SEQ ID NO: 648 - DNA, 404 bp, Artificial Sequence
  gnl|Fabrus|VH3-43_IGHD2-21*01_IGHJ6*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatagagcatattgtggtggtgattgctattccgattactactactactacggtatggacgtctgggggcaagggaccacggtcaccgtctcctcagctagc

SEQ ID NO: 649 - DNA, 413 bp, Artificial Sequence
  gnl|Fabrus|VH3-43_IGHD3-16*01_IGHJ6*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagataggtattatgattacgtttgggggagttatgcttataccgattactactactactacggtatggacgtctgggggcaagggaccacggtcaccgtctcctcagctagc

SEQ ID NO: 650 - DNA, 392 bp, Artificial Sequence
  gnl|Fabrus|VH3-43_IGHD3-22*01_IGHJ4*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagataggtattactatgatagtagtggttattactacgactactttgactactggggccaaggaaccctggtcaccgtctcctcagctagc

SEQ ID NO: 651 - DNA, 380 bp, Artificial Sequence
  gnl|Fabrus|VH3-43_IGHD4-23*01_IGHJ3*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatagtgactacggtggtaactccgatgcttttgatgtctggggccaagggacaatggtcaccgtctcttcagctagc

SEQ ID NO: 652 - DNA, 383 bp, Artificial Sequence
  gnl|Fabrus|VH3-43_IGHD5-18*01_IGHJ5*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatagtggatacagctatggttacgacaactggttcgactcctggggccaaggaaccctggtcaccgtctcctcagctagc

SEQ ID NO: 653 - DNA, 380 bp, Artificial Sequence
  gnl|Fabrus|VH3-43_IGHD6-13*01_IGHJ4*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatgggtatagcagcagctggtacgactactttgactactggggccaaggaaccctggtcaccgtctcctcagctagc

SEQ ID NO: 654 - DNA, 374 bp, Artificial Sequence
  gnl|Fabrus|VH3-43_IGHD7-27*01_IGHJ1*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatactaactggggagctgaatacttccagcactggggccagggcaccctggtcaccgtctcctcagctagc

SEQ ID NO: 655 - DNA, 380 bp, Artificial Sequence
  gnl|Fabrus|VH3-48_IGHD6-6*01_IGHJ1*01
ccatggcagaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgcgagagaggagtatagcagctcgtccgctgaatacttccagcactggggccagggcaccctggtcaccgtctcctcagctagc

SEQ ID NO: 656 - DNA, 383 bp, Artificial Sequence
  gnl|Fabrus|VH3-49_IGHD1-26*01_IGHJ4*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagggtatagtgggagctactacgactactttgactactggggccaaggaaccctggtcaccgtctcctcagctagc

SEQ ID NO: 657 - DNA, 395 bp, Artificial Sequence
  gnl|Fabrus|VH3-49_IGHD1-7*01_IGHJ6*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagggtataactggaactacgattactactactactacggtatggacgtctgggggcaagggaccacggtcaccgtctcctcagctagc

SEQ ID NO: 658 - DNA, 410 bp, Artificial Sequence
  gnl|Fabrus|VH3-49_IGHD2-2*01_IGHJ6*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagaaggatattgtagtagtaccagctgctatgccgattactactactactacggtatggacgtctgggggcaagggaccacggtcaccgtctcctcagctagc

SEQ ID NO: 659 - DNA, 395 bp, Artificial Sequence
  gnl|Fabrus|VH3-49_IGHD2-8*01_IGHJ4*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagaaggatattgtactaatggtgtatgctataccgactactttgactactggggccaaggaaccctggtcaccgtctcctcagctagc

SEQ ID NO: 660 - DNA, 395 bp, Artificial Sequence
  gnl|Fabrus|VH3-49_IGHD3-22*01_IGHJ4*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagagtattactatgatagtagtggttattactacgactactttgactactggggccaaggaaccctggtcaccgtctcctcagctagc

SEQ ID NO: 661 - DNA, 410 bp, Artificial Sequence
  gnl|Fabrus|VH3-49_IGHD3-9*01_IGHJ6*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagagtattacgatattttgactggttattataacgattactactactactacggtatggacgtctgggggcaagggaccacggtcaccgtctcctcagctagc

SEQ ID NO: 662 - DNA, 383 bp, Artificial Sequence
  gnl|Fabrus|VH3-49_IGHD5-18*01_IGHJ4*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaggtggatacagctatggttacgactactttgactactggggccaaggaaccctggtcaccgtctcctcagctagc

SEQ ID NO: 663 - DNA, 386 bp, Artificial Sequence
  gnl|Fabrus|VH3-49_IGHD6-13*01_IGHJ4*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagaggggtatagcagcagctggtacgactactttgactactggggccaaggaaccctggtcaccgtctcctcagctagc

SEQ ID NO: 664 - DNA, 377 bp, Artificial Sequence
  gnl|Fabrus|VH3-49_IGHD7-27*01_IGHJ1*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagctaactggggagctgaatacttccagcactggggccagggcaccctggtcaccgtctcctcagctagc

SEQ ID NO: 665 - DNA, 386 bp, Artificial Sequence
  gnl|Fabrus|VH3-53_IGHD1-14*01_IGHJ6*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagggtataaccggaaccacgattactactactactacggtatggacgtctgggggcaagggaccacggtcaccgtctcctcagctagc

SEQ ID NO: 666 - DNA, 374 bp, Artificial Sequence
  gnl|Fabrus|VH3-53_IGHD1-7*01_IGHJ1*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagggtataactggaactacgctgaatacttccagcactggggccagggcaccctggtcaccgtctcctcagctagc

SEQ ID NO: 667 - DNA, 389 bp, Artificial Sequence
  gnl|Fabrus|VH3-53_IGHD2-2*01_IGHJ2*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagaaggatattgtagtagtaccagctgctatgcctactggtacttcgatctctggggccgtggcaccctggtcactgtctcctcagctagc

SEQ ID NO: 668 - DNA, 386 bp, Artificial Sequence
  gnl|Fabrus|VH3-53_IGHD3-22*01_IGHJ3*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagagtattactatgatagtagtggttattactacgatgcttttgatgtctggggccaagggacaatggtcaccgtctcttcagctagc

SEQ ID NO: 669 - DNA, 377 bp, Artificial Sequence
  gnl|Fabrus|VH3-53_IGHD4-23*01_IGHJ1*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagatgactacggtggtaactccgctgaatacttccagcactggggccagggcaccctggtcaccgtctcctcagctagc

SEQ ID NO: 670 - DNA, 374 bp, Artificial Sequence
  gnl|Fabrus|VH3-53_IGHD5-5*01_IGHJ4*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagaggtggatacagctatggttacgactactttgactactggggccaaggaaccctggtcaccgtctcctcagctagc

SEQ ID NO: 671 - DNA, 377 bp, Artificial Sequence
  gnl|Fabrus|VH3-53_IGHD6-13*01_IGHJ3*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagaggggtatagcagcagctggtacgatgcttttgatgtctggggccaagggacaatggtcaccgtctcttcagctagc

SEQ ID NO: 672 - DNA, 365 bp, Artificial Sequence
  gnl|Fabrus|VH3-53_IGHD7-27*01_IGHJ4*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagctaactggggagactactttgactactggggccaaggaaccctggtcaccgtctcctcagctagc

SEQ ID NO: 673 - DNA, 377 bp, Artificial Sequence
  gnl|Fabrus|VH3-64_IGHD1-26*01_IGHJ4*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagggtatagtgggagctactacgactactttgactactggggccaaggaaccctggtcaccgtctcctcagctagc

SEQ ID NO: 674 - DNA, 389 bp, Artificial Sequence
  gnl|Fabrus|VH3-64_IGHD1-7*01_IGHJ6*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagggtataactggaactacgattactactactactacggtatggacgtctgggggcaagggaccacggtcaccgtctcctcagctagc

SEQ ID NO: 675 - DNA, 392 bp, Artificial Sequence
  gnl|Fabrus|VH3-64_IGHD2-2*01_IGHJ5*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagaaggatattgtagtagtaccagctgctatgccgacaactggttcgactcctggggccaaggaaccctggtcaccgtctcctcagctagc

SEQ ID NO: 676 - DNA, 389 bp, Artificial Sequence
  gnl|Fabrus|VH3-64_IGHD3-3*01_IGHJ4*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagagtattacgatttttggagtggttattataccgactactttgactactggggccaaggaaccctggtcaccgtctcctcagctagc

SEQ ID NO: 677 - DNA, 374 bp, Artificial Sequence
  gnl|Fabrus|VH3-64_IGHD4-17*01_IGHJ4*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagatgactacggtgactacgactactttgactactggggccaaggaaccctggtcaccgtctcctcagctagc

SEQ ID NO: 678 - DNA, 380 bp, Artificial Sequence
  gnl|Fabrus|VH3-64_IGHD5-12*01_IGHJ4*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagaggtggatatagtggctacgattacgactactttgactactggggccaaggaaccctggtcaccgtctcctcagctagc

SEQ ID NO: 679 - DNA, 383 bp, Artificial Sequence
  gnl|Fabrus|VH3-64_IGHD6-19*01_IGHJ1*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagaggggtatagcagtggctggtacgctgaatacttccagcactggggccagggcaccctggtcaccgtctcctcagctagc

SEQ ID NO: 680 - DNA, 368 bp, Artificial Sequence
  gnl|Fabrus|VH3-64_IGHD7-27*01_IGHJ4*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagctaactggggagactactttgactactggggccaaggaaccctggtcaccgtctcctcagctagc

SEQ ID NO: 681 - DNA, 377 bp, Artificial Sequence
  gnl|Fabrus|VH3-66_IGHD6-6*01_IGHJ1*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagctgtggtagcacatactacgcagactccgtgaagggccgattcaccatctccagagacaattccaagaacacgctgtatcttcaaatgaacagcctgagagctgaggacacggctgtgtattactgtgcgagagaggagtatagcagctcgtccgctgaatacttccagcactggggccagggcaccctggtcaccgtctcctcagctagc

SEQ ID NO: 682 - DNA, 374 bp, Artificial Sequence
  gnl|Fabrus|VH3-7_IGHD1-20*01_IGHJ3*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagggtataactggaacgacgatgcttttgatgtctggggccaagggacaatggtcaccgtctcttcagctagc

SEQ ID NO: 683 - DNA, 389 bp, Artificial Sequence
  gnl|Fabrus|VH3-7_IGHD1-7*01_IGHJ6*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagggtataactggaactacgattactactactactacggtatggacgtctgggggcaagggaccacggtcaccgtctcctcagctagc

SEQ ID NO: 684 - DNA, 389 bp, Artificial Sequence
  gnl|Fabrus|VH3-7_IGHD2-21*01_IGHJ5*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaagcatattgtggtggtgattgctattccgacaactggttcgactcctggggccaaggaaccctggtcaccgtctcctcagctagc

SEQ ID NO: 685 - DNA, 401 bp, Artificial Sequence
  gnl|Fabrus|VH3-7_IGHD2-8*01_IGHJ6*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaggatattgtactaatggtgtatgctatacattactactactactacggtatggacgtctgggggcaagggaccacggtcaccgtctcctcagctagc

SEQ ID NO: 686 - DNA, 389 bp, Artificial Sequence
  gnl|Fabrus|VH3-7_IGHD3-22*01_IGHJ3*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagagtattactatgatagtagtggttattactacgatgcttttgatgtctggggccaagggacaatggtcaccgtctcttcagctagc

SEQ ID NO: 687 - DNA, 404 bp, Artificial Sequence
  gnl|Fabrus|VH3-7_IGHD3-9*01_IGHJ6*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagagtattacgatattttgactggttattataacgattactactactactacggtatggacgtctgggggcaagggaccacggtcaccgtctcctcagctagc

SEQ ID NO: 688 - DNA, 374 bp, Artificial Sequence
  gnl|Fabrus|VH3-7_IGHD4-17*01_IGHJ4*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagatgactacggtgactacgactactttgactactggggccaaggaaccctggtcaccgtctcctcagctagc

SEQ ID NO: 689 - DNA, 380 bp, Artificial Sequence
  gnl|Fabrus|VH3-7_IGHD5-12*01_IGHJ4*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagaggtggatatagtggctacgattacgactactttgactactggggccaaggaaccctggtcaccgtctcctcagctagc

SEQ ID NO: 690 - DNA, 377 bp, Artificial Sequence
  gnl|Fabrus|VH3-7_IGHD5-24*01_IGHJ4*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaggtagagatggctacaattaactactttgactactggggccaaggaaccctggtcaccgtctcctcagctagc

SEQ ID NO: 691 - DNA, 395 bp, Artificial Sequence
  gnl|Fabrus|VH3-7_IGHD6-19*01_IGHJ6*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaggggtatagcagtggctggtacgattactactactactacggtatggacgtctgggggcaagggaccacggtcaccgtctcctcagctagc

SEQ ID NO: 692 - DNA, 380 bp, Artificial Sequence
  gnl|Fabrus|VH3-7_IGHD6-6*01_IGHJ1*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaggagtatagcagctcgtccgctgaatacttccagcactggggccagggcaccctggtcaccgtctcctcagctagc

SEQ ID NO: 693 - DNA, 371 bp, Artificial Sequence
  gnl|Fabrus|VH3-7_IGHD7-27*01_IGHJ2*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagctaactggggatactggtacttcgatctctggggccgtggcaccctggtcactgtctcctcagctagc

SEQ ID NO: 694 - DNA, 380 bp, Artificial Sequence
  gnl|Fabrus|VH3-72_IGHD1-1*01_IGHJ4*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagggtacaactggaacgacgactactttgactactggggccaaggaaccctggtcaccgtctcctcagctagc

SEQ ID NO: 695 - DNA, 398 bp, Artificial Sequence
  gnl|Fabrus|VH3-72_IGHD2-15*01_IGHJ1*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagaaggatattgtagtggtggtagctgctactccgctgaatacttccagcactggggccagggcaccctggtcaccgtctcctcagctagc

SEQ ID NO: 696 - DNA, 395 bp, Artificial Sequence
  gnl|Fabrus|VH3-72_IGHD3-22*01_IGHJ4*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagagtattactatgatagtagtggttattactacgactactttgactactggggccaaggaaccctggtcaccgtctcctcagctagc

SEQ ID NO: 697 - DNA, 410 bp, Artificial Sequence
  gnl|Fabrus|VH3-72_IGHD3-9*01_IGHJ6*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagagtattacgatattttgactggttattataacgattactactactactacggtatggacgtctgggggcaagggaccacggtcaccgtctcctcagctagc

SEQ ID NO: 698 - DNA, 386 bp, Artificial Sequence
  gnl|Fabrus|VH3-72_IGHD4-23*01_IGHJ2*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagatgactacggtggtaactcctactggtacttcgatctctggggccgtggcaccctggtcactgtctcctcagctagc

SEQ ID NO: 699 - DNA, 383 bp, Artificial Sequence
  gnl|Fabrus|VH3-72_IGHD5-18*01_IGHJ4*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagaggtggatacagctatggttacgactactttgactactggggccaaggaaccctggtcaccgtctcctcagctagc

SEQ ID NO: 700 - DNA, 398 bp, Artificial Sequence
  gnl|Fabrus|VH3-72_IGHD5-24*01_IGHJ6*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagaggtagagatggctacaattacgattactactactactacggtatggacgtctgggggcaagggaccacggtcaccgtctcctcagctagc

SEQ ID NO: 701 - DNA, 386 bp, Artificial Sequence
  gnl|Fabrus|VH3-72_IGHD6-6*01_IGHJ1*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagaggagtatagcagctcgtccgctgaatacttccagcactggggccagggcaccctggtcaccgtctcctcagctagc

SEQ ID NO: 702 - DNA, 377 bp, Artificial Sequence
  gnl|Fabrus|VH3-72_IGHD7-27*01_IGHJ2*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagctaactggggatactggtacttcgatctctggggccgtggcaccctggtcactgtctcctcagctagc

SEQ ID NO: 703 - DNA, 383 bp, Artificial Sequence
  gnl|Fabrus|VH3-73_IGHD1-1*01_IGHJ5*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacggtacaactggaacgacgacaactggttcgactcctggggccaaggaaccctggtcaccgtctcctcagctagc

SEQ ID NO: 704 - DNA, 398 bp, Artificial Sequence
  gnl|Fabrus|VH3-73_IGHD2-8*01_IGHJ2*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacaaggatattgtactaatggtgtatgctatacctactggtacttcgatctctggggccgtggcaccctggtcactgtctcctcagctagc

SEQ ID NO: 705 - DNA, 395 bp, Artificial Sequence
  gnl|Fabrus|VH3-73_IGHD3-22*01_IGHJ4*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacagtattactatgatagtagtggttattactacgactactttgactactggggccaaggaaccctggtcaccgtctcctcagctagc

SEQ ID NO: 706 - DNA, 410 bp, Artificial Sequence
  gnl|Fabrus|VH3-73_IGHD3-9*01_IGHJ6*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacagtattacgatattttgactggttattataacgattactactactactacggtatggacgtctgggggcaagggaccacggtcaccgtctcctcagctagc

SEQ ID NO: 707 - DNA, 395 bp, Artificial Sequence
  gnl|Fabrus|VH3-73_IGHD4-11*01_IGHJ6*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacatgactacagtaactacgattactactactactacggtatggacgtctgggggcaagggaccacggtcaccgtctcctcagctagc

SEQ ID NO: 708 - DNA, 386 bp, Artificial Sequence
  gnl|Fabrus|VH3-73_IGHD4-23*01_IGHJ5*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacatgactacggtggtaactccgacaactggttcgactcctggggccaaggaaccctggtcaccgtctcctcagctagc

SEQ ID NO: 709 - DNA, 386 bp, Artificial Sequence
  gnl|Fabrus|VH3-73_IGHD5-12*01_IGHJ4*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacgtggatatagtggctacgattacgactactttgactactggggccaaggaaccctggtcaccgtctcctcagctagc

SEQ ID NO: 710 - DNA, 389 bp, Artificial Sequence
  gnl|Fabrus|VH3-73_IGHD6-19*01_IGHJ1*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacaggggtatagcagtggctggtacgctgaatacttccagcactggggccagggcaccctggtcaccgtctcctcagctagc

SEQ ID NO: 711 - DNA, 377 bp, Artificial Sequence
  gnl|Fabrus|VH3-73_IGHD7-27*01_IGHJ5*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacctaactggggagacaactggttcgactcctggggccaaggaaccctggtcaccgtctcctcagctagc

SEQ ID NO: 712 - DNA, 389 bp, Artificial Sequence
  gnl|Fabrus|VH3-74_IGHD1-1*01_IGHJ6*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagggtacaactggaacgacgattactactactactacggtatggacgtctgggggcaagggaccacggtcaccgtctcctcagctagc

SEQ ID NO: 713 - DNA, 377 bp, Artificial Sequence
  gnl|Fabrus|VH3-74_IGHD1-26*01_IGHJ4*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagggtatagtgggagctactacgactactttgactactggggccaaggaaccctggtcaccgtctcctcagctagc

SEQ ID NO: 714 - DNA, 392 bp, Artificial Sequence
  gnl|Fabrus|VH3-74_IGHD2-2*01_IGHJ5*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagaaggatattgtagtagtaccagctgctatgccgacaactggttcgactcctggggccaaggaaccctggtcaccgtctcctcagctagc

SEQ ID NO: 715 - DNA, 392 bp, Artificial Sequence
  gnl|Fabrus|VH3-74_IGHD3-22*01_IGHJ5*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagagtattactatgatagtagtggttattactacgacaactggttcgactcctggggccaaggaaccctggtcaccgtctcctcagctagc

SEQ ID NO: 716 - DNA, 377 bp, Artificial Sequence
  gnl|Fabrus|VH3-74_IGHD4-17*01_IGHJ1*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagatgactacggtgactacgctgaatacttccagcactggggccagggcaccctggtcaccgtctcctcagctagc

SEQ ID NO: 717 - DNA, 380 bp, Artificial Sequence
  gnl|Fabrus|VH3-74_IGHD5-12*01_IGHJ4*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagaggtggatatagtggctacgattacgactactttgactactggggccaaggaaccctggtcaccgtctcctcagctagc

SEQ ID NO: 718 - DNA, 380 bp, Artificial Sequence
  gnl|Fabrus|VH3-74_IGHD6-6*01_IGHJ1*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagaggagtatagcagctcgtccgctgaatacttccagcactggggccagggcaccctggtcaccgtctcctcagctagc

SEQ ID NO: 719 - DNA, 368 bp, Artificial Sequence
  gnl|Fabrus|VH3-74_IGHD7-27*01_IGHJ4*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagctaactggggagactactttgactactggggccaaggaaccctggtcaccgtctcctcagctagc

SEQ ID NO: 720 - DNA, 392 bp, Artificial Sequence
  gnl|Fabrus|VH3-9_IGHD1-1*01_IGHJ6*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagataggtacaactggaacgacgattactactactactacggtatggacgtctgggggcaagggaccacggtcaccgtctcctcagctagc

SEQ ID NO: 721 - DNA, 380 bp, Artificial Sequence
  gnl|Fabrus|VH3-9_IGHD1-7*01_IGHJ5*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagataggtataactggaactacgacaactggttcgactcctggggccaaggaaccctggtcaccgtctcctcagctagc

SEQ ID NO: 722 - DNA, 392 bp, Artificial Sequence
  gnl|Fabrus|VH3-9_IGHD2-2*01_IGHJ4*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatagaggatattgtagtagtaccagctgctatgccgactactttgactactggggccaaggaaccctggtcaccgtctcctcagctagc

SEQ ID NO: 723 - DNA, 413 bp, Artificial Sequence
  gnl|Fabrus|VH3-9_IGHD3-16*01_IGHJ6*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagataggtattatgattacgtttgggggagttatgcttataccgattactactactactacggtatggacgtctgggggcaagggaccacggtcaccgtctcctcagctagc

SEQ ID NO: 724 - DNA, 392 bp, Artificial Sequence
  gnl|Fabrus|VH3-9_IGHD3-22*01_IGHJ4*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagataggtattactatgatagtagtggttattactacgactactttgactactggggccaaggaaccctggtcaccgtctcctcagctagc

SEQ ID NO: 725 - DNA, 377 bp, Artificial Sequence
  gnl|Fabrus|VH3-9_IGHD4-11*01_IGHJ4*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatagtgactacagtaactacgactactttgactactggggccaaggaaccctggtcaccgtctcctcagctagc

SEQ ID NO: 726 - DNA, 383 bp, Artificial Sequence
  gnl|Fabrus|VH3-9_IGHD5-24*01_IGHJ1*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatagtagagatggctacaattacgctgaatacttccagcactggggccagggcaccctggtcaccgtctcctcagctagc

SEQ ID NO: 727 - DNA, 380 bp, Artificial Sequence
  gnl|Fabrus|VH3-9_IGHD6-13*01_IGHJ4*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatgggtatagcagcagctggtacgactactttgactactggggccaaggaaccctggtcaccgtctcctcagctagc

SEQ ID NO: 728 - DNA, 392 bp, Artificial Sequence
  gnl|Fabrus|VH3-9_IGHD6-25*01_IGHJ6*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatgggtatagcagcggctacgattactactactactacggtatggacgtctgggggcaagggaccacggtcaccgtctcctcagctagc

SEQ ID NO: 729 - DNA, 374 bp, Artificial Sequence
  gnl|Fabrus|VH3-9_IGHD7-27*01_IGHJ2*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatactaactggggatactggtacttcgatctctggggccgtggcaccctggtcactgtctcctcagctagc

SEQ ID NO: 730 - DNA, 377 bp, Artificial Sequence
  gnl|Fabrus|VH4-28_IGHD1-20*01_IGHJ1*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaggtataactggaacgacgctgaatacttccagcactggggccagggcaccctggtcaccgtctcctcagctagc

SEQ ID NO: 731 - DNA, 389 bp, Artificial Sequence
  gnl|Fabrus|VH4-28_IGHD1-7*01_IGHJ6*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaggtataactggaactacgattactactactactacggtatggacgtctgggggcaagggaccacggtcaccgtctcctcagctagc

SEQ ID NO: 732 - DNA, 404 bp, Artificial Sequence
  gnl|Fabrus|VH4-28_IGHD2-15*01_IGHJ6*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaaaggatattgtagtggtggtagctgctactccgattactactactactacggtatggacgtctgggggcaagggaccacggtcaccgtctcctcagctagc

SEQ ID NO: 733 - DNA, 398 bp, Artificial Sequence
  gnl|Fabrus|VH4-28_IGHD3-16*01_IGHJ2*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaagtattatgattacgtttgggggagttatgcttatacctactggtacttcgatctctggggccgtggcaccctggtcactgtctcctcagctagc

SEQ ID NO: 734 - DNA, 404 bp, Artificial Sequence
  gnl|Fabrus|VH4-28_IGHD3-9*01_IGHJ6*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaagtattacgatattttgactggttattataacgattactactactactacggtatggacgtctgggggcaagggaccacggtcaccgtctcctcagctagc

SEQ ID NO: 735 - DNA, 374 bp, Artificial Sequence
  gnl|Fabrus|VH4-28_IGHD4-4*01_IGHJ4*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaatgactacagtaactacgactactttgactactggggccaaggaaccctggtcaccgtctcctcagctagc

SEQ ID NO: 736 - DNA, 380 bp, Artificial Sequence
  gnl|Fabrus|VH4-28_IGHD5-5*01_IGHJ1*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaagtggatacagctatggttacgctgaatacttccagcactggggccagggcaccctggtcaccgtctcctcagctagc

SEQ ID NO: 737 - DNA, 380 bp, Artificial Sequence
  gnl|Fabrus|VH4-28_IGHD6-13*01_IGHJ4*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaaggggtatagcagcagctggtacgactactttgactactggggccaaggaaccctggtcaccgtctcctcagctagc

SEQ ID NO: 738 - DNA, 371 bp, Artificial Sequence
  gnl|Fabrus|VH4-28_IGHD7-27*01_IGHJ1*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaactaactggggagctgaatacttccagcactggggccagggcaccctggtcaccgtctcctcagctagc

SEQ ID NO: 739 - DNA, 383 bp, Artificial Sequence
  gnl|Fabrus|VH4-31_IGHD1-26*01_IGHJ2*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagggtatagtgggagctactactactggtacttcgatctctggggccgtggcaccctggtcactgtctcctcagctagc

SEQ ID NO: 740 - DNA, 395 bp, Artificial Sequence
  gnl|Fabrus|VH4-31_IGHD2-15*01_IGHJ2*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagaaggatattgtagtggtggtagctgctactcctactggtacttcgatctctggggccgtggcaccctggtcactgtctcctcagctagc

SEQ ID NO: 741 - DNA, 407 bp, Artificial Sequence
  gnl|Fabrus|VH4-31_IGHD2-2*01_IGHJ6*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagaaggatattgtagtagtaccagctgctatgccgattactactactactacggtatggacgtctgggggcaagggaccacggtcaccgtctcctcagctagc

SEQ ID NO: 742 - DNA, 392 bp, Artificial Sequence
  gnl|Fabrus|VH4-31_IGHD3-10*01_IGHJ4*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagagtattactatggttcggggagttattataacgactactttgactactggggccaaggaaccctggtcaccgtctcctcagctagc

SEQ ID NO: 743 - DNA, 407 bp, Artificial Sequence
  gnl|Fabrus|VH4-31_IGHD3-9*01_IGHJ6*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagagtattacgatattttgactggttattataacgattactactactactacggtatggacgtctgggggcaagggaccacggtcaccgtctcctcagctagc

SEQ ID NO: 744 - DNA, 380 bp, Artificial Sequence
  gnl|Fabrus|VH4-31_IGHD4-17*01_IGHJ5*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatgactacggtgactacgacaactggttcgactcctggggccaaggaaccctggtcaccgtctcctcagctagc

SEQ ID NO: 745 - DNA, 383 bp, Artificial Sequence
  gnl|Fabrus|VH4-31_IGHD5-12*01_IGHJ4*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagaggtggatatagtggctacgattacgactactttgactactggggccaaggaaccctggtcaccgtctcctcagctagc

SEQ ID NO: 746 - DNA, 383 bp, Artificial Sequence
  gnl|Fabrus|VH4-31_IGHD6-13*01_IGHJ4*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagaggggtatagcagcagctggtacgactactttgactactggggccaaggaaccctggtcaccgtctcctcagctagc

SEQ ID NO: 747 - DNA, 383 bp, Artificial Sequence
  gnl|Fabrus|VH4-31_IGHD6-6*01_IGHJ1*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagaggagtatagcagctcgtccgctgaatacttccagcactggggccagggcaccctggtcaccgtctcctcagctagc

SEQ ID NO: 748 - DNA, 374 bp, Artificial Sequence
  gnl|Fabrus|VH4-31_IGHD7-27*01_IGHJ5*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagctaactggggagacaactggttcgactcctggggccaaggaaccctggtcaccgtctcctcagctagc

SEQ ID NO: 749 - DNA, 371 bp, Artificial Sequence
  gnl|Fabrus|VH4-34_IGHD1-7*01_IGHJ4*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagggtataactggaactacgactactttgactactggggccaaggaaccctggtcaccgtctcctcagctagc

SEQ ID NO: 750 - DNA, 386 bp, Artificial Sequence
  gnl|Fabrus|VH4-34_IGHD2-2*01_IGHJ4*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggaggatattgtagtagtaccagctgctatgccgactactttgactactggggccaaggaaccctggtcaccgtctcctcagctagc

SEQ ID NO: 751 - DNA, 392 bp, Artificial Sequence
  gnl|Fabrus|VH4-34_IGHD3-16*01_IGHJ4*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagggtattatgattacgtttgggggagttatgcttataccgactactttgactactggggccaaggaaccctggtcaccgtctcctcagctagc

SEQ ID NO: 752 - DNA, 401 bp, Artificial Sequence
  gnl|Fabrus|VH4-34_IGHD3-22*01_IGHJ6*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagggtattactatgatagtagtggttattactacgattactactactactacggtatggacgtctgggggcaagggaccacggtcaccgtctcctcagctagc

SEQ ID NO: 753 - DNA, 371 bp, Artificial Sequence
  gnl|Fabrus|VH4-34_IGHD4-17*01_IGHJ4*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggtgactacggtgactacgactactttgactactggggccaaggaaccctggtcaccgtctcctcagctagc

SEQ ID NO: 754 - DNA, 377 bp, Artificial Sequence
  gnl|Fabrus|VH4-34_IGHD5-12*01_IGHJ4*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggtggatatagtggctacgattacgactactttgactactggggccaaggaaccctggtcaccgtctcctcagctagc

SEQ ID NO: 755 - DNA, 377 bp, Artificial Sequence
  gnl|Fabrus|VH4-34_IGHD6-13*01_IGHJ4*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggggggtatagcagcagctggtacgactactttgactactggggccaaggaaccctggtcaccgtctcctcagctagc

SEQ ID NO: 756 - DNA, 389 bp, Artificial Sequence
  gnl|Fabrus|VH4-34_IGHD6-25*01_IGHJ6*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggggggtatagcagcggctacgattactactactactacggtatggacgtctgggggcaagggaccacggtcaccgtctcctcagctagc

SEQ ID NO: 757 - DNA, 389 bp, Artificial Sequence
  gnl|Fabrus|VH4-34_IGHD6-6*01_IGHJ6*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggggagtatagcagctcgtccgattactactactactacggtatggacgtctgggggcaagggaccacggtcaccgtctcctcagctagc

SEQ ID NO: 758 - DNA, 365 bp, Artificial Sequence
  gnl|Fabrus|VH4-34_IGHD7-27*01_IGHJ4*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagctaactggggagactactttgactactggggccaaggaaccctggtcaccgtctcctcagctagc

SEQ ID NO: 759 - DNA, 380 bp, Artificial Sequence
  gnl|Fabrus|VH4-39_IGHD1-14*01_IGHJ1*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacggtataaccggaaccacgctgaatacttccagcactggggccagggcaccctggtcaccgtctcctcagctagc

SEQ ID NO: 760 - DNA, 392 bp, Artificial Sequence
  gnl|Fabrus|VH4-39_IGHD1-20*01_IGHJ6*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacggtataactggaacgacgattactactactactacggtatggacgtctgggggcaagggaccacggtcaccgtctcctcagctagc

SEQ ID NO: 761 - DNA, 389 bp, Artificial Sequence
  gnl|Fabrus|VH4-39_IGHD2-21*01_IGHJ3*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacaagcatattgtggtggtgattgctattccgatgcttttgatgtctggggccaagggacaatggtcaccgtctcttcagctagc

SEQ ID NO: 762 - DNA, 392 bp, Artificial Sequence
  gnl|Fabrus|VH4-39_IGHD3-10*01_IGHJ4*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacagtattactatggttcggggagttattataacgactactttgactactggggccaaggaaccctggtcaccgtctcctcagctagc

SEQ ID NO: 763 - DNA, 401 bp, Artificial Sequence
  gnl|Fabrus|VH4-39_IGHD3-16*01_IGHJ2*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacagtattatgattacgtttgggggagttatgcttatacctactggtacttcgatctctggggccgtggcaccctggtcactgtctcctcagctagc

SEQ ID NO: 764 - DNA, 407 bp, Artificial Sequence
  gnl|Fabrus|VH4-39_IGHD3-9*01_IGHJ6*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacagtattacgatattttgactggttattataacgattactactactactacggtatggacgtctgggggcaagggaccacggtcaccgtctcctcagctagc

SEQ ID NO: 765 - DNA, 383 bp, Artificial Sequence
  gnl|Fabrus|VH4-39_IGHD4-23*01_IGHJ2*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacatgactacggtggtaactcctactggtacttcgatctctggggccgtggcaccctggtcactgtctcctcagctagc

SEQ ID NO: 766 - DNA, 383 bp, Artificial Sequence
  gnl|Fabrus|VH4-39_IGHD5-12*01_IGHJ4*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacgtggatatagtggctacgattacgactactttgactactggggccaaggaaccctggtcaccgtctcctcagctagc

SEQ ID NO: 767 - DNA, 383 bp, Artificial Sequence
  gnl|Fabrus|VH4-39_IGHD6-6*01_IGHJ1*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacaggagtatagcagctcgtccgctgaatacttccagcactggggccagggcaccctggtcaccgtctcctcagctagc

SEQ ID NO: 768 - DNA, 371 bp, Artificial Sequence
  gnl|Fabrus|VH4-4_IGHD1-20*01_IGHJ3*01
ccatggcacaggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagggtataactggaacgacgatgcttttgatgtctggggccaagggacaatggtcaccgtctcttcagctagc

SEQ ID NO: 769 - DNA, 386 bp, Artificial Sequence
  gnl|Fabrus|VH4-4_IGHD2-8*01_IGHJ4*01
ccatggcacaggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagaaggatattgtactaatggtgtatgctataccgactactttgactactggggccaaggaaccctggtcaccgtctcctcagctagc

SEQ ID NO: 770 - DNA, 389 bp, Artificial Sequence
  gnl|Fabrus|VH4-4_IGHD3-22*01_IGHJ2*01
ccatggcacaggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagagtattactatgatagtagtggttattactactactggtacttcgatctctggggccgtggcaccctggtcactgtctcctcagctagc

SEQ ID NO: 771 - DNA, 374 bp, Artificial Sequence
  gnl|Fabrus|VH4-4_IGHD4-23*01_IGHJ4*01
ccatggcacaggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagatgactacggtggtaactccgactactttgactactggggccaaggaaccctggtcaccgtctcctcagctagc

SEQ ID NO: 772 - DNA, 380 bp, Artificial Sequence
  gnl|Fabrus|VH4-4_IGHD5-12*01_IGHJ5*01
ccatggcacaggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagaggtggatatagtggctacgattacgacaactggttcgactcctggggccaaggaaccctggtcaccgtctcctcagctagc

SEQ ID NO: 773 - DNA, 374 bp, Artificial Sequence
  gnl|Fabrus|VH4-4_IGHD6-6*01_IGHJ4*01
ccatggcacaggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagaggagtatagcagctcgtccgactactttgactactggggccaaggaaccctggtcaccgtctcctcagctagc

SEQ ID NO: 774 - DNA, 380 bp, Artificial Sequence
  gnl|Fabrus|VH4-4_IGHD7-27*01_IGHJ6*01
ccatggcacaggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagctaactggggagattactactactactacggtatggacgtctgggggcaagggaccacggtcaccgtctcctcagctagc

SEQ ID NO: 775 - DNA, 374 bp, Artificial Sequence
  gnl|Fabrus|VH4-59_IGHD6-25*01_IGHJ3*01
ccatggcacaggtgcagctgcaggagtcgggcccaggactggtgaagccttcggagaccctgtccctcacctgcactgtctctggtggctccatcagtagttactactggagctggattcggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagaggggtatagcagcggctacgatgcttttgatgtctggggccaagggacaatggtcaccgtctcttcagctagc

SEQ ID NO: 776 - DNA, 374 bp, Artificial Sequence
  gnl|Fabrus|VH5-51_IGHD1-14*01_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacggtataaccggaaccacgactactttgactactggggccaaggaaccctggtcaccgtctcctcagctagc

SEQ ID NO: 777 - DNA, 392 bp, Artificial Sequence
  gnl|Fabrus|VH5-51_IGHD1-26*01_IGHJ6*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacggtatagtgggagctactacgattactactactactacggtatggacgtctgggggcaagggaccacggtcaccgtctcctcagctagc

SEQ ID NO: 778 - DNA, 389 bp, Artificial Sequence
  gnl|Fabrus|VH5-51_IGHD2-8*01_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacaaggatattgtactaatggtgtatgctataccgactactttgactactggggccaaggaaccctggtcaccgtctcctcagctagc

SEQ ID NO: 779 - DNA, 404 bp, Artificial Sequence
  gnl|Fabrus|VH5-51_IGHD3-10*01_IGHJ6*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacagtattactatggttcggggagttattataacgattactactactactacggtatggacgtctgggggcaagggaccacggtcaccgtctcctcagctagc

SEQ ID NO: 780 - DNA, 389 bp, Artificial Sequence
  gnl|Fabrus|VH5-51_IGHD3-3*01_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacagtattacgatttttggagtggttattataccgactactttgactactggggccaaggaaccctggtcaccgtctcctcagctagc

SEQ ID NO: 781 - DNA, 374 bp, Artificial Sequence
  gnl|Fabrus|VH5-51_IGHD4-17*01_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacatgactacggtgactacgactactttgactactggggccaaggaaccctggtcaccgtctcctcagctagc

SEQ ID NO: 782 - DNA, 377 bp, Artificial Sequence
  gnl|Fabrus|VH5-51_IGHD5-18*01>3_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacgtggatacagctatggttacgactactttgactactggggccaaggaaccctggtcaccgtctcctcagctagc

SEQ ID NO: 783 - DNA, 377 bp, Artificial Sequence
  gnl|Fabrus|VH5-51_IGHD5-18*01>1_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacaggtggatacagctatggttaactactttgactactggggccaaggaaccctggtcaccgtctcctcagctagc

SEQ ID NO: 784 - DNA, 377 bp, Artificial Sequence
  gnl|Fabrus|VH5-51_IGHD6-25*01_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacaggggtatagcagcggctacgactactttgactactggggccaaggaaccctggtcaccgtctcctcagctagc

SEQ ID NO: 785 - DNA, 368 bp, Artificial Sequence
  gnl|Fabrus|VH5-51_IGHD7-27*01_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacagctaactggggactactttgactactggggccaaggaaccctggtcaccgtctcctcagctagc

SEQ ID NO: 786 - DNA, 383 bp, Artificial Sequence
  gnl|Fabrus|VH6-1_IGHD1-1*01_IGHJ4*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagggtacaactggaacgacgactactttgactactggggccaaggaaccctggtcaccgtctcctcagctagc

SEQ ID NO: 787 - DNA, 398 bp, Artificial Sequence
  gnl|Fabrus|VH6-1_IGHD1-20*01_IGHJ6*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagggtataactggaacgacgattactactactactacggtatggacgtctgggggcaagggaccacggtcaccgtctcctcagctagc

SEQ ID NO: 788 - DNA, 398 bp, Artificial Sequence
  gnl|Fabrus|VH6-1_IGHD2-15*01_IGHJ4*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaaggatattgtagtggtggtagctgctactccgactactttgactactggggccaaggaaccctggtcaccgtctcctcagctagc

SEQ ID NO: 789 - DNA, 410 bp, Artificial Sequence
  gnl|Fabrus|VH6-1_IGHD2-21*01_IGHJ6*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaagcatattgtggtggtgattgctattccgattactactactactacggtatggacgtctgggggcaagggaccacggtcaccgtctcctcagctagc

SEQ ID NO: 790 - DNA, 407 bp, Artificial Sequence
  gnl|Fabrus|VH6-1_IGHD3-16*01_IGHJ5*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagagtattatgattacgtttgggggagttatgcttataccgacaactggttcgactcctggggccaaggaaccctggtcaccgtctcctcagctagc

SEQ ID NO: 791 - DNA, 398 bp, Artificial Sequence
  gnl|Fabrus|VH6-1_IGHD3-3*01_IGHJ4*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagagtattacgatttttggagtggttattataccgactactttgactactggggccaaggaaccctggtcaccgtctcctcagctagc

SEQ ID NO: 792 - DNA, 398 bp, Artificial Sequence
  gnl|Fabrus|VH6-1_IGHD4-11*01_IGHJ6*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagatgactacagtaactacgattactactactactacggtatggacgtctgggggcaagggaccacggtcaccgtctcctcagctagc

SEQ ID NO: 793 - DNA, 386 bp, Artificial Sequence
  gnl|Fabrus|VH6-1_IGHD4-23*01_IGHJ4*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagatgactacggtggtaactccgactactttgactactggggccaaggaaccctggtcaccgtctcctcagctagc

SEQ ID NO: 794 - DNA, 386 bp, Artificial Sequence
  gnl|Fabrus|VH6-1_IGHD5-5*01_IGHJ4*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagaggtggatacagctatggttacgactactttgactactggggccaaggaaccctggtcaccgtctcctcagctagc

SEQ ID NO: 795 - DNA, 389 bp, Artificial Sequence
  gnl|Fabrus|VH6-1_IGHD6-13*01_IGHJ4*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaggggtatagcagcagctggtacgactactttgactactggggccaaggaaccctggtcaccgtctcctcagctagc

SEQ ID NO: 796 - DNA, 401 bp, Artificial Sequence
  gnl|Fabrus|VH6-1_IGHD6-25*01_IGHJ6*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaggggtatagcagcggctacgattactactactactacggtatggacgtctgggggcaagggaccacggtcaccgtctcctcagctagc

SEQ ID NO: 797 - DNA, 377 bp, Artificial Sequence
  gnl|Fabrus|VH6-1_IGHD7-27*01_IGHJ4*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagctaactggggagactactttgactactggggccaaggaaccctggtcaccgtctcctcagctagc

SEQ ID NO: 798 - DNA, 374 bp, Artificial Sequence
  gnl|Fabrus|VH7-81_IGHD1-14*01_IGHJ4*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatggtataaccggaaccacgactactttgactactggggccaaggaaccctggtcaccgtctcctcagctagc

SEQ ID NO: 799 - DNA, 389 bp, Artificial Sequence
  gnl|Fabrus|VH7-81_IGHD2-21*01_IGHJ2*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatatgcatattgtggtggtgattgctattcctactggtacttcgatctctggggccgtggcaccctggtcactgtctcctcagctagc

SEQ ID NO: 800 - DNA, 401 bp, Artificial Sequence
  gnl|Fabrus|VH7-81_IGHD2-21*01_IGHJ6*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatatgcatattgtggtggtgattgctattccgattactactactactacggtatggacgtctgggggcaagggaccacggtcaccgtctcctcagctagc

SEQ ID NO: 801 - DNA, 410 bp, Artificial Sequence
  gnl|Fabrus|VH7-81_IGHD3-16*01_IGHJ6*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatattattatgattacgtttgggggagttatgcttataccgattactactactactacggtatggacgtctgggggcaagggaccacggtcaccgtctcctcagctagc

SEQ ID NO: 802 - DNA, 380 bp, Artificial Sequence
  gnl|Fabrus|VH7-81_IGHD4-23*01_IGHJ1*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatatgactacggtggtaactccgctgaatacttccagcactggggccagggcaccctggtcaccgtctcctcagctagc

SEQ ID NO: 803 - DNA, 395 bp, Artificial Sequence
  gnl|Fabrus|VH7-81_IGHD5-12*01_IGHJ6*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatgtggatatagtggctacgattacgattactactactactacggtatggacgtctgggggcaagggaccacggtcaccgtctcctcagctagc

SEQ ID NO: 804 - DNA, 377 bp, Artificial Sequence
  gnl|Fabrus|VH7-81_IGHD6-25*01_IGHJ4*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatatgggtatagcagcggctacgactactttgactactggggccaaggaaccctggtcaccgtctcctcagctagc

SEQ ID NO: 805 - DNA, 368 bp, Artificial Sequence
  gnl|Fabrus|VH7-81_IGHD7-27*01_IGHJ4*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatctaactggggagactactttgactactggggccaaggaaccctggtcaccgtctcctcagctagc

SEQ ID NO: 806 - DNA, 338 bp, Artificial Sequence
  gnl|Fabrus|A14_IGKJ1*01
ccatggcggatgttgtgatgacacagtctccagctttcctctctgtgactccaggggagaaagtcaccatcacctgccaggccagtgaaggcattggcaactacttatactggtaccagcagaaaccagatcaagccccaaagctcctcatcaagtatgcttcccagtccatctcaggggtcccgtcgaggttcagtggcagtggatctgggacagatttcacctttaccatcagtagcctggaagctgaagatgctgcaacatattactgtcagcagggcaataagcaccctcagtggacgttcggccaagggaccaaggtggaaatcaaacgtact

SEQ ID NO: 807 - DNA, 353 bp, Artificial Sequence
  gnl|Fabrus|A17_IGKJ1*01
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtact

SEQ ID NO: 808 - DNA, 353 bp, Artificial Sequence
  gnl|Fabrus|A2_IGKJ1*01
ccatggcggatattgtgatgacccagactccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttcctccgtggacgttcggccaagggaccaaggtggaaatcaaacgtact

SEQ ID NO: 809 - DNA, 338 bp, Artificial Sequence
  gnl|Fabrus|A20_IGKJ1*01
ccatggcggacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccctccgtggacgttcggccaagggaccaaggtggaaatcaaacgtact

SEQ ID NO: 810 - DNA, 353 bp, Artificial Sequence
  gnl|Fabrus|A23_IGKJ1*01
ccatggcggatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatttcctcagtggacgttcggccaagggaccaaggtggaaatcaaacgtact

SEQ ID NO: 811 - DNA, 338 bp, Artificial Sequence
  gnl|Fabrus|A26_IGKJ1*01
ccatggcggaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccttctcaggggtcccgtcgaggttcagtggcagtggatctgggacagatttcaccctcaccatcaatagcctggaagctgaagatgctgcaacgtattactgtcatcagagtagtagtttacctcagtggacgttcggccaagggaccaaggtggaaatcaaacgtact

SEQ ID NO: 812 - DNA, 341 bp, Artificial Sequence
  gnl|Fabrus|A27_IGKJ1*01
ccatggcggaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgtggacgttcggccaagggaccaaggtggaaatcaaacgtacg

SEQ ID NO: 813 - DNA, 341 bp, Artificial Sequence
  gnl|Fabrus|A27_IGKJ3*01
ccatggcggaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccattcactttcggccctgggaccaaagtggatatcaaacgtact

SEQ ID NO: 814 - DNA, 338 bp, Artificial Sequence
  gnl|Fabrus|A30_IGKJ1*01
ccatggcggacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaatttactctcacaatcagcagcctgcagcctgaagattttgcaacttattactgtctacagcataatagttaccctccgtggacgttcggccaagggaccaaggtggaaatcaaacgtact

SEQ ID NO: 815 - DNA, 338 bp, Artificial Sequence
  gnl|Fabrus|B2_IGKJ1*01
ccatggcggaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccctctgtggacgttcggccaagggaccaaggtggaaatcaaacgtact

SEQ ID NO: 816 - DNA, 338 bp, Artificial Sequence
  gnl|Fabrus|B2_IGKJ3*01
ccatggcggaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccctctattcactttcggccctgggaccaaagtggatatcaaacgtacg

SEQ ID NO: 817 - DNA, 356 bp, Artificial Sequence
  gnl|Fabrus|B3_IGKJ1*01
ccatggcggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctccgtggacgttcggccaagggaccaaggtggaaatcaaacgtact

SEQ ID NO: 818 - DNA, 335 bp, Artificial Sequence
  gnl|Fabrus|HerceptinLC
ccatggcggacattcagatgacccagagcccgagcagcctgagcgcgagcgtgggcgatcgtgtgaccattacctgccgtgccagccaggatgtgaacaccgcggtggcgtggtatcagcagaaaccgggtaaagccccgaaactgctgatttatagcgccagctttctgtatagcggcgtgccgagccgttttagcggtagccgcagcggcaccgattttaccctgaccattagcagcctgcagccggaagattttgccacctattattgccagcagcattataccaccccgccgacctttggccagggcaccaaagtggaaattaaacgtacg

SEQ ID NO: 819 - DNA, 338 bp, Artificial Sequence
  gnl|Fabrus|L11_IGKJ1*01
ccatggcggccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattaccctccgtggacgttcggccaagggaccaaggtggaaatcaaacgtact

SEQ ID NO: 820 - DNA, 338 bp, Artificial Sequence
  gnl|Fabrus|L12_IGKJ1*01
ccatggcggacatccagatgacccagtctccttccaccctgtctgcatctgtaggagacagagtcaccatcacttgccgggccagtcagagtattagtagctggttggcctggtatcagcagaaaccagggaaagcccctaagctcctgatctatgatgcctccagtttggaaagtggggtcccatcaaggttcagcggcagtggatctgggacagaatttactctcaccatcagcagcctgcagcctgatgattttgcaacttattactgccaacagtataatagttattctccgtggacgttcggccaagggaccaaggtggaaatcaaacgtact

SEQ ID NO: 821 - DNA, 338 bp, Artificial Sequence
  gnl|Fabrus|L14_IGKJ1*01
ccatggcgaacatccagatgacccagtctccatctgccatgtctgcatctgtaggagacagagtcaccatcacttgtcgggcgaggcagggcattagcaattatttagcctggtttcagcagaaaccagggaaagtccctaagcacctgatctatgctgcatccagtttgcaaagtggggtcccatcaaggttcagcggcagtggatctgggacagaatttactctcacaatcagcagcctgcagcctgaagattttgcaacttattactgtctacagcataatagttaccctccgtggacgttcggccaagggaccaaggtggaaatcaaacgtact

SEQ ID NO: 822 - DNA, 338 bp, Artificial Sequence
  gnl|Fabrus|L2_IGKJ1*01
ccatggcggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccgtggacgttcggccaagggaccaaggtggaaatcaaacgtact

SEQ ID NO: 823 - DNA, 338 bp, Artificial Sequence
  gnl|Fabrus|L22_IGKJ3*01
ccatggcggacatccagatgatccagtctccatctttcctgtctgcatctgtaggagacagagtcagtatcatttgctgggcaagtgagggcattagcagtaatttagcctggtatctgcagaaaccagggaaatcccctaagctcttcctctatgatgcaaaagatttgcaccctggggtctcatcgaggttcagtggcaggggatctgggacggatttcactctcaccatcatcagcctgaagcctgaagattttgcagcttattactgtaaacaggacttcagttaccctccattcactttcggccctgggaccaaagtggatatcaaacgtacg

SEQ ID NO: 824 - DNA, 338 bp, Artificial Sequence
  gnl|Fabrus|L23_IGKJ1*01
ccatggcggccatccggatgacccagtctccattctccctgtctgcatctgtaggagacagagtcaccatcacttgctgggccagtcagggcattagcagttatttagcctggtatcagcaaaaaccagcaaaagcccctaagctcttcatctattatgcatccagtttgcaaagtggggtcccatcaaggttcagcggcagtggatctgggacggattacactctcaccatcagcagcctgcagcctgaagattttgcaacttattactgtcaacagtattatagtacccctccgtggacgttcggccaagggaccaaggtggaaatcaaacgtact

SEQ ID NO: 825 - DNA, 341 bp, Artificial Sequence
  gnl|Fabrus|L25_IGKJ1*01
ccatggcggaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctccgtggacgttcggccaagggaccaaggtggaaatcaaacgtact

SEQ ID NO: 826 - DNA, 341 bp, Artificial Sequence
  gnl|Fabrus|L25_IGKJ3*01
ccatggcggaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctccattcactttcggccctgggaccaaagtggatatcaaacgtacg

SEQ ID NO: 827 - DNA, 338 bp, Artificial Sequence
  gnl|Fabrus|L4/18a_IGKJ1*01
ccatggcggccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccctcagtggacgttcggccaagggaccaaggtggaaatcaaacgtact

SEQ ID NO: 828 - DNA, 338 bp, Artificial Sequence
  gnl|Fabrus|L5_IGKJ1*01
ccatggcggacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgtggacgttcggccaagggaccaaggtggaaatcaaacgtact

SEQ ID NO: 829 - DNA, 338 bp, Artificial Sequence
  gnl|Fabrus|L6_IGKJ1*01
ccatggcggaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgtggacgttcggccaagggaccaaggtggaaatcaaacgtact

SEQ ID NO: 830 - DNA, 338 bp, Artificial Sequence
  gnl|Fabrus|L8_IGKJ1*01
ccatggcggacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaatttactctcacaatcagcagcctgcagcctgaagattttgcaacttattactgtcaacagcttaatagttaccctccgtggacgttcggccaagggaccaaggtggaaatcaaacgtact

SEQ ID NO: 831 - DNA, 338 bp, Artificial Sequence
  gnl|Fabrus|L9_IGKJ2*01
ccatggcggccatccggatgacccagtctccatcctcattctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttaccctctgtatacttttggccaggggaccaagctggagatcaaacgtact

SEQ ID NO: 832 - DNA, 356 bp, Artificial Sequence
  gnl|Fabrus|O1_IGKJ1*01
ccatggcggatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttccttcgtggacgttcggccaagggaccaaggtggaaatcaaacgtact

SEQ ID NO: 833 - DNA, 338 bp, Artificial Sequence
  gnl|Fabrus|O12_IGKJ1*01
ccatggcggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgtggacgttcggccaagggaccaaggtggaaatcaaacgtact

SEQ ID NO: 834 - DNA, 338 bp, Artificial Sequence
  gnl|Fabrus|O18_IGKJ1*01
ccatggcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctccgtggacgttcggccaagggaccaaggtggaaatcaaacgtact

SEQ ID NO: 835 - DNA, 330 bp, Artificial Sequence
  gnl|Fabrus|Anti-CD20 LC
ccatggcggatcgtgctgagccagagccccgccatcctgagcgccagccccggcgagaaggtgaccatgacctgcagggccagcagcagcgtgagctacatgcactggtaccagcagaagcccggcagcagccccaagccctggatctacgcccccagcaacctggccagcggcgtgcccgccaggttcagcggcagcggcagcggcaccagctacagcctgaccatcagcagggtggaggccgaggacgccgccacctactactgccagcagtggagcttcaacccccccaccttcggcgccggcaccaagctggagctgaagcgtacg

SEQ ID NO: 836 - DNA, 343 bp, Artificial Sequence
  gnl|Fabrus|V1-11_IGLJ2*01
ccatggcgcagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggtcctgtggtattcggcggagggaccaagctgaccgtcctagg

SEQ ID NO: 837 - DNA, 346 bp, Artificial Sequence
  gnl|Fabrus|V1-13_IGLJ5*01
ccatggcgcagtctgtgctgacgcagccgccctcagtgtctggggccccagggcagagggtcaccatctcctgcactgggagcagctccaacatcggggcaggttatgatgtgcactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttcctgggtgtttggtgaggggaccgagctgaccgtcctagg

SEQ ID NO: 838 - DNA, 343 bp, Artificial Sequence
  gnl|Fabrus|V1-16_IGLJ6*01
ccatggcgcagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcctaatgtgttcggcagtggcaccaaggtgaccgtcctagg

SEQ ID NO: 839 - DNA, 346 bp, Artificial Sequence
  gnl|Fabrus|V1-18_IGLJ2*01
ccatggcgcagtctgtgctgacgcagccgccctcagtgtctggggccccagggcagagggtcaccatctcctgcactgggagcagctccaacattggggcgggttatgttgtgcattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgaatgctcatgtggtattcggcggagggaccaagctgaccgtcctagg

SEQ ID NO: 840 - DNA, 343 bp, Artificial Sequence
  gnl|Fabrus|V1-2_IGLJ7*01
ccatggcgcagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttcgctgtgttcggaggaggcacccagctgaccgtcctagg

SEQ ID NO: 841 - DNA, 343 bp, Artificial Sequence
  gnl|Fabrus|V1-20_IGLJ6*01
ccatggcgcaggcagggctgactcagccaccctcggtgtccaagggcttgagacagaccgccacactcacctgcactgggaacagcaacattgttggcaaccaaggagcagcttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcattggacagcagcctcagtgctcataatgtgttcggcagtggcaccaaggtgaccgtcctagg

SEQ ID NO: 842 - DNA, 343 bp, Artificial Sequence
  gnl|Fabrus|V1-3_IGLJ1*01
ccatggcgcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttctatgtcttcggaactgggaccaaggtcaccgtcctagg

SEQ ID NO: 843 - DNA, 343 bp, Artificial Sequence
  gnl|Fabrus|V1-4_IGLJ4*01
ccatggcgcagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctctttgtatttggtggaggaacccagctgatcatcctagg

SEQ ID NO: 844 - DNA, 343 bp, Artificial Sequence
  gnl|Fabrus|V1-5_IGLJ2*01
ccatggcgcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagcttatatacaagcagcagcactttcgtggtattcggcggagggaccaagctgaccgtcctagg

SEQ ID NO: 845 - DNA, 343 bp, Artificial Sequence
  gnl|Fabrus|V1-7_IGLJ1*01
ccatggcgcagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttctatgtcttcggaactgggaccaaggtcaccgtcctagg

SEQ ID NO: 846 - DNA, 343 bp, Artificial Sequence
  gnl|Fabrus|V1-9_IGLJ6*01
ccatggcgcaatctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttacactttcaatgtgttcggcagtggcaccaaggtgaccgtcctagg

SEQ ID NO: 847 - DNA, 331 bp, Artificial Sequence
  gnl|Fabrus|V2-1_IGLJ6*01
ccatggcgtcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcaggcatccctgagcgattctctggctccaactctgggaacacagccactctgaccatcagcgggacccaggctatggatgaggctgactattactgtcaggcgtgggacagcagcactgcaaatgtgttcggcagtggcaccaaggtgaccgtcctagg

SEQ ID NO: 848 - DNA, 337 bp, Artificial Sequence
  gnl|Fabrus|V2-11_IGLJ7*01
ccatggcgtcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcaggcatccctgagcgattctctggctccagctcagggacaatagtcacattgaccatcagtggagtccaggcagaagacgaggctgactattactgtctatcagcagacagcagtggtacttatcctgctgtgttcggaggaggcacccagctgaccgtcctagg

SEQ ID NO: 849 - DNA, 337 bp, Artificial Sequence
  gnl|Fabrus|V2-13_IGLJ2*01
ccatggcgtcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcaggcatcccagaccgattctctggctccagctcaggaaacacagcttccttgaccatcactggggctcaggcggaagatgaggctgactattactgtaactcccgggacagcagtggtaaccatcttgtggtattcggcggagggaccaagctgaccgtcctagg

SEQ ID NO: 850 - DNA, 337 bp, Artificial Sequence
  gnl|Fabrus|V2-14_IGLJ4*01
ccatggcgtcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcaggcatccctgagcgattctctggctccaactctgggaacacggccaccctgaccatcagcagggtcgaagccggggatgaggccgactattactgtcaggtgtgggatagtagtagtgatcatccttttgtatttggtggaggaacccagctgatcatcctagg

SEQ ID NO: 851 - DNA, 331 bp, Artificial Sequence
  gnl|Fabrus|V2-15_IGLJ7*01
ccatggcgtcctatgagctgacacagctaccctcggtgtcagtgtccccaggacagacagccaggatcacctgctctggagatgtactgggggaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctggggatgaggacaatcctgctgtgttcggaggaggcacccagctgaccgtcctagg

SEQ ID NO: 852 - DNA, 337 bp, Artificial Sequence
  gnl|Fabrus|V2-17_IGLJ2*01
ccatggcgtcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcaggcatccctgagcgattctctggctccagctcagggacaacagtcacgttgaccatcagtggagtccaggcagaagatgaggctgactattactgtcaatcagcagacagcagtggtacttatcctgtggtattcggcggagggaccaagctgaccgtcctagg

SEQ ID NO: 853 - DNA, 331 bp, Artificial Sequence
  gnl|Fabrus|V2-19_IGLJ4*01
ccatggcgtcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcaggcatccctgagcgattctccggctccagctcagggaccacagtcaccttgaccatcagcggggcccaggttgaggatgaggctgactattactgttactctgcggctgacaacaatctttttgtatttggtggaggaacccagctgatcatcctagg

SEQ ID NO: 854 - DNA, 331 bp, Artificial Sequence
  gnl|Fabrus|V2-6_IGLJ4*01
ccatggcgtcctatgagctgactcagccactctcagtgtcagtggccctgggacagacggccaggattacctgtgggggaaacaacattggaagtaaaaatgtgcactggtaccagcagaagccaggccaggcccctgtgctggtcatctatagggatagcaaccggccctctggcatccctgagcgattctctggctccaactcggggaacacggccaccctgaccatcagcagagcccaagccggggatgaggctgactattactgtcaggtgtgggacagcagcactgcatttgtatttggtggaggaacccagctgatcatcctagg

SEQ ID NO: 855 - DNA, 337 bp, Artificial Sequence
  gnl|Fabrus|V2-7_IGLJ2*01
ccatggcgtcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccggcatccctgagagattctctggctccagctcagggacaatggccaccttgactatcagtggggcccaggtggaggatgaagctgactactactgttactcaacagacagcagtggtaatcatagtgtggtattcggcggagggaccaagctgaccgtcctagg

SEQ ID NO: 856 - DNA, 337 bp, Artificial Sequence
  gnl|Fabrus|V2-7_IGLJ7*01
ccatggcgtcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccggcatccctgagagattctctggctccagctcagggacaatggccaccttgactatcagtggggcccaggtggaggatgaagctgactactactgttactcaacagacagcagtggtaatcatagtgctgtgttcggaggaggcacccagctgaccgtcctagg

SEQ ID NO: 857 - DNA, 337 bp, Artificial Sequence
  gnl|Fabrus|V2-8_IGLJ6*01
ccatggcgtcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcaggcatccctgagcgattctctggctccaacccagggaacaccgccaccctaaccatcagcaggatcgaggctggggatgaggctgactattactgtcaggtgtgggacagtagtagtgatcatcctaatgtgttcggcagtggcaccaaggtgaccgtcctagg

SEQ ID NO: 858 - DNA, 340 bp, Artificial Sequence
  gnl|Fabrus|V3-2_IGLJ4*01
ccatggcgcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgctcagtttgtatttggtggaggaacccagctgatcatcctagg

SEQ ID NO: 859 - DNA, 340 bp, Artificial Sequence
  gnl|Fabrus|V3-3_IGLJ7*01
ccatggcgcaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgctcgggctgtgttcggaggaggcacccagctgaccgtcctagg

SEQ ID NO: 860 - DNA, 343 bp, Artificial Sequence
  gnl|Fabrus|V3-4_IGLJ1*01
ccatggcgcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttcttatgtcttcggaactgggaccaaggtcaccgtcctagg

SEQ ID NO: 861 - DNA, 358 bp, Artificial Sequence
  gnl|Fabrus|V4-1_IGLJ4*01
ccatggcgcagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggctccaaagatgcttcagccaatacagggattttactcatctccgggctccagtctgaggatgaggctgactattactgtatgatttggccaagcaatgcttcttttgtatttggtggaggaacccagctgatcatcctagg

SEQ ID NO: 862 - DNA, 358 bp, Artificial Sequence
  gnl|Fabrus|V4-2_IGLJ4*01
ccatggcgcaggctgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggctccaaagatgcttcggccaatgcagggattttactcatctctgggctccagtctgaggatgaggctgactattactgtatgatttggcacagcagcgcttcttttgtatttggtggaggaacccagctgatcatcctagg

SEQ ID NO: 863 - DNA, 358 bp, Artificial Sequence
  gnl|Fabrus|V4-3_IGLJ4*01
ccatggcgcagcctgtgctgactcagccaacttccctctcagcatctcctggagcatcagccagactcacctgcaccttgcgcagtggcatcaatcttggtagctacaggatattctggtaccagcagaagccagagagccctccccggtatctcctgagctactactcagactcaagtaagcatcagggctctggagtccccagccgcttctctggctccaaagatgcttcgagcaatgcagggattttagtcatctctgggctccagtctgaggatgaggctgactattactgtatgatttggcacagcagtgcttcttttgtatttggtggaggaacccagctgatcatcctagg

SEQ ID NO: 864 - DNA, 364 bp, Artificial Sequence
  gnl|Fabrus|V4-4_IGLJ5*01
ccatggcgcagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggctccaacgatgcatcagccaatgcagggattctgcgtatctctgggctccagcctgaggatgaggctgactattactgtggtacatggcacagcaactctaagactcactgggtgtttggtgaggggaccgagctgaccgtcctagg

SEQ ID NO: 865 - DNA, 358 bp, Artificial Sequence
  gnl|Fabrus|V4-6_IGLJ4*01
ccatggcgcggcccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgctaattttgtatttggtggaggaacccagctgatcatcctagg

SEQ ID NO: 866 - DNA, 346 bp, Artificial Sequence
  gnl|Fabrus|V5-4_IGLJ2*01
ccatggcgcagcctgtgctgactcaatcatcctctgcctctgcttccctgggctcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactcatgtggtattcggcggagggaccaagctgaccgtcctagg

SEQ ID NO: 867 - DNA, 346 bp, Artificial Sequence
  gnl|Fabrus|V5-6_IGLJ1*01
ccatggcgcagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacggcatccctgatcgcttctcaggctccagctctggggctgagcgctacctcaccatctccagcctccagtctgaggatgaggctgactattactgtcagacctggggcactggcattcattatgtcttcggaactgggaccaaggtcaccgtcctagg

SEQ ID NO: 868 - DNA, 287 bp, Homo sapiens
  IGKV1-39*02
gacatccagatgacccagtctccatccttcctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttattactgtcagtgtggttacagtacacctcc

SEQ ID NO: 869 - DNA, 389 bp, Artificial Sequence; identical to SEQ ID NO: 600
  VH3-23 (full length heavy chain variable domain)

SEQ ID NO: 870 - DNA, 381 bp, Artificial Sequence
  VH3-23S (full length variable domain with CDR2 and CDR3 restriction sites)
atggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagaaccggttcaccatctcacgtgacaattccaagaacacgctgtatctgcaaatgaacagcctgagagccgaggacacggccgtatattactgtgcgaaagagacctactatggttcggggagttattataacgactactttggtctctggggccaaggaaccctggtcaccgtctcctca

SEQ ID NO: 871 - DNA, 345 bp, Artificial Sequence
  A17 (full length light chain variable domain)
atggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaa

SEQ ID NO: 872 - DNA, 347 bp, Artificial Sequence
  A17P (full length variable domain with CDR1 restriction sites)
ccatggcggatgttgtgatgactcagtctccactctccctgcccgtcacccttggacagccggcctccatctcctgcgagaccagtcaaagcctcgtatacagtgatggaaacacctacggtctctggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaa

SEQ ID NO: 873 - DNA, 347 bp, Artificial Sequence
  A17Q (full length variable domain with CDR3 restriciton sites)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcgagaccggtacacactggcctccgggtctcttcggccaagggaccaaggtggaaatcaaa

SEQ ID NO: 874 - protein, 20 aa, Artificial Sequence
  EPO peptide 14
GGTYSCHFGPLTWVCKPQGG

SEQ ID NO: 875 - protein, 20 aa, Artificial Sequence
  EPO peptide 18
GPTYSCHFGPLTWVCKPQGG

SEQ ID NO: 876 - protein, 20 aa, Artificial Sequence
  EPO peptide 19
PGTYSCHFGPLTWVCKPQGG

SEQ ID NO: 877 - protein, 20 aa, Artificial Sequence
  EPO peptide 20
PPTYSCHFGPLTWVCKPQGG

SEQ ID NO: 878 - protein, 20 aa, Artificial Sequence
  EPO peptide 21
GGTYSCHFGPLTWVCKPQGP

SEQ ID NO: 879 - protein, 20 aa, Artificial Sequence
  EPO peptide 22
GPTYSCHFGPLTWVCKPQGP

SEQ ID NO: 880 - protein, 20 aa, Artificial Sequence
  EPO peptide 23
PGTYSCHFGPLTWVCKPQGP

SEQ ID NO: 881 - protein, 20 aa, Artificial Sequence
  EPO peptide 24
PPTYSCHFGPLTWVCKPQGP

SEQ ID NO: 882 - protein, 20 aa, Artificial Sequence
  EPO peptide 25
GGTYSCHFGPLTWVCKPQPG

SEQ ID NO: 883 - protein, 20 aa, Artificial Sequence
  EPO peptide 26
GPTYSCHFGPLTWVCKPQPG

SEQ ID NO: 884 - protein, 20 aa, Artificial Sequence
  EPO peptide 27
PGTYSCHFGPLTWVCKPQPG

SEQ ID NO: 885 - protein, 20 aa, Artificial Sequence
  EPO peptide 28
PPTYSCHFGPLTWVCKPQPG

SEQ ID NO: 886 - protein, 20 aa, Artificial Sequence
  EPO peptide 29
GGTYSCHFGPLTWVCKPQPP

SEQ ID NO: 887 - protein, 20 aa, Artificial Sequence
  EPO peptide 30
GPTYSCHFGPLTWVCKPQPP

SEQ ID NO: 888 - protein, 20 aa, Artificial Sequence
  EPO peptide 31
PGTYSCHFGPLTWVCKPQPP

SEQ ID NO: 889 - protein, 20 aa, Artificial Sequence
  EPO peptide 32
PPTYSCHFGPLTWVCKPQPP

SEQ ID NO: 890 - protein, 14 aa, Artificial Sequence
  Epo peptide 11
YSCHFGPLTWVCKP

SEQ ID NO: 891 - protein, 16 aa, Artificial Sequence
  Epo peptide 12
TYSCHFGPLTWVCKPQ

SEQ ID NO: 892 - protein, 18 aa, Artificial Sequence
  Epo peptide 13
GTYSCHFGPLTWVCKPQG

SEQ ID NO: 893 - protein, 18 aa, Artificial Sequence
  Epo peptide 15
GTYSCHFGPLTWVCKPQP

SEQ ID NO: 894 - protein, 18 aa, Artificial Sequence
  Epo peptide 16
PTYSCHFGPLTWVCKPQG

SEQ ID NO: 895 - protein, 18 aa, Artificial Sequence
  Epo peptide 17
PTYSCHFGPLTWVCKPQP

SEQ ID NO: 896 - DNA, 826 bp, Artificial Sequence
  VH3-23B
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcagagaccagtggtagtggtggtagcacatactacgcagactccgtgggtctccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 897 - DNA, 835 bp, Artificial Sequence
  H2-EP14 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaggcggcacctatagctgccattttggcccgctgacctgggtgtgcaaaccgcagggcggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 898 - DNA, 835 bp, Artificial Sequence
  H2-EP18 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaggcccaacctatagctgccattttggcccgctgacctgggtgtgcaaaccgcagggcggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 899 - DNA, 835 bp, Artificial Sequence
  H2-EP19 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaccaggcacctatagctgccattttggcccgctgacctgggtgtgcaaaccgcagggcggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 900 - DNA, 835 bp, Artificial Sequence
  H2-EP20 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaccaccaacctatagctgccattttggcccgctgacctgggtgtgcaaaccgcagggcggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 901 - DNA, 835 bp, Artificial Sequence
  H2-EP21 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaggcggcacctatagctgccattttggcccgctgacctgggtgtgcaaaccgcagggcccacggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 902 - DNA, 835 bp, Artificial Sequence
  H2-EP22 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaggcccaacctatagctgccattttggcccgctgacctgggtgtgcaaaccgcagggcccacggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 903 - DNA, 835 bp, Artificial Sequence
  H2-EP23 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaccaggcacctatagctgccattttggcccgctgacctgggtgtgcaaaccgcagggcccacggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 904 - DNA, 835 bp, Artificial Sequence
  H2-EP24 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaccaccaacctatagctgccattttggcccgctgacctgggtgtgcaaaccgcagggcccacggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 905 - DNA, 835 bp, Artificial Sequence
  H2-EP25 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaggcggcacctatagctgccattttggcccgctgacctgggtgtgcaaaccgcagccaggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 906 - DNA, 835 bp, Artificial Sequence
  H2-EP26 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaggcccaacctatagctgccattttggcccgctgacctgggtgtgcaaaccgcagccaggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 907 - DNA, 835 bp, Artificial Sequence
  H2-EP27 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaccaggcacctatagctgccattttggcccgctgacctgggtgtgcaaaccgcagccaggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 908 - DNA, 835 bp, Artificial Sequence
  H2-EP28 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaccaccaacctatagctgccattttggcccgctgacctgggtgtgcaaaccgcagccaggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 909 - DNA, 835 bp, Artificial Sequence
  H2-EP29 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaggcggcacctatagctgccattttggcccgctgacctgggtgtgcaaaccgcagccaccacggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 910 - DNA, 835 bp, Artificial Sequence
  H2-EP30 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaggcccaacctatagctgccattttggcccgctgacctgggtgtgcaaaccgcagccaccacggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 911 - DNA, 835 bp, Artificial Sequence
  H2-EP31 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaccaggcacctatagctgccattttggcccgctgacctgggtgtgcaaaccgcagccaccacggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 912 - DNA, 835 bp, Artificial Sequence
  H2-EP32 (VH3-23B)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgtcaccaccaacctatagctgccattttggcccgctgacctgggtgtgcaaaccgcagccaccacggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 913 - DNA, 826 bp, Artificial Sequence
  VH3-23R
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagacctactatggttcggggagttattataacgactactttggtctctggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 914 - DNA, 838 bp, Artificial Sequence
  H3-EP14 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcggcacctatagctgccattttggcccgctgacctgggtgtgcaaaccgcagggcggctggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 915 - DNA, 838 bp, Artificial Sequence
  H3-EP18 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcccaacctatagctgccattttggcccgctgacctgggtgtgcaaaccgcagggcggctggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 916 - DNA, 838 bp, Artificial Sequence
  H3-EP19 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccaggcacctatagctgccattttggcccgctgacctgggtgtgcaaaccgcagggcggctggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 917 - DNA, 838 bp, Artificial Sequence
  H3-EP20 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccaccaacctatagctgccattttggcccgctgacctgggtgtgcaaaccgcagggcggctggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 918 - DNA, 838 bp, Artificial Sequence
  H3-EP21 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcggcacctatagctgccattttggcccgctgacctgggtgtgcaaaccgcagggcccatggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 919 - DNA, 838 bp, Artificial Sequence
  H3-EP22 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcccaacctatagctgccattttggcccgctgacctgggtgtgcaaaccgcagggcccatggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 920 - DNA, 838 bp, Artificial Sequence
  H3-EP23 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccaggcacctatagctgccattttggcccgctgacctgggtgtgcaaaccgcagggcccatggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 921 - DNA, 838 bp, Artificial Sequence
  H3-EP24 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccaccaacctatagctgccattttggcccgctgacctgggtgtgcaaaccgcagggcccatggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 922 - DNA, 838 bp, Artificial Sequence
  H3-EP25 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcggcacctatagctgccattttggcccgctgacctgggtgtgcaaaccgcagccaggctggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 923 - DNA, 838 bp, Artificial Sequence
  H3-EP26 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcccaacctatagctgccattttggcccgctgacctgggtgtgcaaaccgcagccaggctggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 924 - DNA, 838 bp, Artificial Sequence
  H3-EP27 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccaggcacctatagctgccattttggcccgctgacctgggtgtgcaaaccgcagccaggctggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 925 - DNA, 838 bp, Artificial Sequence
  H3-EP28 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccaccaacctatagctgccattttggcccgctgacctgggtgtgcaaaccgcagccaggctggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 926 - DNA, 838 bp, Artificial Sequence
  H3-EP29 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcggcacctatagctgccattttggcccgctgacctgggtgtgcaaaccgcagccaccatggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 927 - DNA, 838 bp, Artificial Sequence
  H3-EP30 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcccaacctatagctgccattttggcccgctgacctgggtgtgcaaaccgcagccaccatggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 928 - DNA, 838 bp, Artificial Sequence
  H3-EP31 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccaggcacctatagctgccattttggcccgctgacctgggtgtgcaaaccgcagccaccatggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 929 - DNA, 838 bp, Artificial Sequence
  H3-EP32 (VH3-23R)
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccaccaacctatagctgccattttggcccgctgacctgggtgtgcaaaccgcagccaccatggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgag

SEQ ID NO: 930 - DNA, 752 bp, Artificial Sequence
  L1-EP14 (A17P)
ccatggcggatgttgtgatgactcagtctccactctccctgcccgtcacccttggacagccggcctccatctcctgcggcggcacctatagctgccattttggcccgctgacctgggtgtgcaaaccgcagggcggctggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 931 - DNA, 752 bp, Artificial Sequence
  L1-EP18 (A17P)
ccatggcggatgttgtgatgactcagtctccactctccctgcccgtcacccttggacagccggcctccatctcctgcggcccaacctatagctgccattttggcccgctgacctgggtgtgcaaaccgcagggcggctggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 932 - DNA, 752 bp, Artificial Sequence
  L1-EP19 (A17P)
ccatggcggatgttgtgatgactcagtctccactctccctgcccgtcacccttggacagccggcctccatctcctgcccaggcacctatagctgccattttggcccgctgacctgggtgtgcaaaccgcagggcggctggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 933 - DNA, 752 bp, Artificial Sequence
  L1-EP20 (A17P)
ccatggcggatgttgtgatgactcagtctccactctccctgcccgtcacccttggacagccggcctccatctcctgcccaccaacctatagctgccattttggcccgctgacctgggtgtgcaaaccgcagggcggctggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 934 - DNA, 752 bp, Artificial Sequence
  L1-EP21 (A17P)
ccatggcggatgttgtgatgactcagtctccactctccctgcccgtcacccttggacagccggcctccatctcctgcggcggcacctatagctgccattttggcccgctgacctgggtgtgcaaaccgcagggcccatggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 935 - DNA, 752 bp, Artificial Sequence
  L1-EP22 (A17P)
ccatggcggatgttgtgatgactcagtctccactctccctgcccgtcacccttggacagccggcctccatctcctgcggcccaacctatagctgccattttggcccgctgacctgggtgtgcaaaccgcagggcccatggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 936 - DNA, 752 bp, Artificial Sequence
  L1-EP23 (A17P)
ccatggcggatgttgtgatgactcagtctccactctccctgcccgtcacccttggacagccggcctccatctcctgcccaggcacctatagctgccattttggcccgctgacctgggtgtgcaaaccgcagggcccatggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 937 - DNA, 752 bp, Artificial Sequence
  L1-EP24 (A17P)
ccatggcggatgttgtgatgactcagtctccactctccctgcccgtcacccttggacagccggcctccatctcctgcccaccaacctatagctgccattttggcccgctgacctgggtgtgcaaaccgcagggcccatggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 938 - DNA, 752 bp, Artificial Sequence
  L1-EP25 (A17P)
ccatggcggatgttgtgatgactcagtctccactctccctgcccgtcacccttggacagccggcctccatctcctgcggcggcacctatagctgccattttggcccgctgacctgggtgtgcaaaccgcagccaggctggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 939 - DNA, 752 bp, Artificial Sequence
  L1-EP26 (A17P)
ccatggcggatgttgtgatgactcagtctccactctccctgcccgtcacccttggacagccggcctccatctcctgcggcccaacctatagctgccattttggcccgctgacctgggtgtgcaaaccgcagccaggctggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 940 - DNA, 752 bp, Artificial Sequence
  L1-EP27 (A17P)
ccatggcggatgttgtgatgactcagtctccactctccctgcccgtcacccttggacagccggcctccatctcctgcccaggcacctatagctgccattttggcccgctgacctgggtgtgcaaaccgcagccaggctggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 941 - DNA, 752 bp, Artificial Sequence
  L1-EP28 (A17P)
ccatggcggatgttgtgatgactcagtctccactctccctgcccgtcacccttggacagccggcctccatctcctgcccaccaacctatagctgccattttggcccgctgacctgggtgtgcaaaccgcagccaggctggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 942 - DNA, 752 bp, Artificial Sequence
  L1-EP29 (A17P)
ccatggcggatgttgtgatgactcagtctccactctccctgcccgtcacccttggacagccggcctccatctcctgcggcggcacctatagctgccattttggcccgctgacctgggtgtgcaaaccgcagccaccatggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 943 - DNA, 752 bp, Artificial Sequence
  L1-EP30 (A17P)
ccatggcggatgttgtgatgactcagtctccactctccctgcccgtcacccttggacagccggcctccatctcctgcggcccaacctatagctgccattttggcccgctgacctgggtgtgcaaaccgcagccaccatggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 944 - DNA, 752 bp, Artificial Sequence
  L1-EP31 (A17P)
ccatggcggatgttgtgatgactcagtctccactctccctgcccgtcacccttggacagccggcctccatctcctgcccaggcacctatagctgccattttggcccgctgacctgggtgtgcaaaccgcagccaccatggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 945 - DNA, 752 bp, Artificial Sequence
  L1-EP32 (A17P)
ccatggcggatgttgtgatgactcagtctccactctccctgcccgtcacccttggacagccggcctccatctcctgcccaccaacctatagctgccattttggcccgctgacctgggtgtgcaaaccgcagccaccatggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 946 - DNA, 770 bp, Artificial Sequence
  L3-EP14 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcggcggcacctatagctgccattttggcccgctgacctgggtgtgcaaaccgcagggcggcttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 947 - DNA, 770 bp, Artificial Sequence
  L3-EP18 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcggcccaacctatagctgccattttggcccgctgacctgggtgtgcaaaccgcagggcggcttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 948 - DNA, 770 bp, Artificial Sequence
  L3-EP19 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcccaggcacctatagctgccattttggcccgctgacctgggtgtgcaaaccgcagggcggcttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 949 - DNA, 770 bp, Artificial Sequence
  L3-EP20 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcccaccaacctatagctgccattttggcccgctgacctgggtgtgcaaaccgcagggcggcttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 950 - DNA, 770 bp, Artificial Sequence
  L3-EP21 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcggcggcacctatagctgccattttggcccgctgacctgggtgtgcaaaccgcagggcccattcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 951 - DNA, 770 bp, Artificial Sequence
  L3-EP22 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcggcccaacctatagctgccattttggcccgctgacctgggtgtgcaaaccgcagggcccattcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 952 - DNA, 770 bp, Artificial Sequence
  L3-EP23 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcccaggcacctatagctgccattttggcccgctgacctgggtgtgcaaaccgcagggcccattcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 953 - DNA, 770 bp, Artificial Sequence
  L3-EP24 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcccaccaacctatagctgccattttggcccgctgacctgggtgtgcaaaccgcagggcccattcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 954 - DNA, 770 bp, Artificial Sequence
  L3-EP25 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcggcggcacctatagctgccattttggcccgctgacctgggtgtgcaaaccgcagccaggcttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 955 - DNA, 770 bp, Artificial Sequence
  L3-EP26 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcggcccaacctatagctgccattttggcccgctgacctgggtgtgcaaaccgcagccaggcttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 956 - DNA, 770 bp, Artificial Sequence
  L3-EP27 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcccaggcacctatagctgccattttggcccgctgacctgggtgtgcaaaccgcagccaggcttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 957 - DNA, 770 bp, Artificial Sequence
  L3-EP28 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcccaccaacctatagctgccattttggcccgctgacctgggtgtgcaaaccgcagccaggcttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 958 - DNA, 770 bp, Artificial Sequence
  L3-EP29 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcggcggcacctatagctgccattttggcccgctgacctgggtgtgcaaaccgcagccaccattcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 959 - DNA, 770 bp, Artificial Sequence
  L3-EP30 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcggcccaacctatagctgccattttggcccgctgacctgggtgtgcaaaccgcagccaccattcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 960 - DNA, 770 bp, Artificial Sequence
  L3-EP31 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcccaggcacctatagctgccattttggcccgctgacctgggtgtgcaaaccgcagccaccattcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 961 - DNA, 770 bp, Artificial Sequence
  L3-EP32 (A17Q)
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcccaccaacctatagctgccattttggcccgctgacctgggtgtgcaaaccgcagccaccattcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgag

SEQ ID NO: 962 - DNA, 1526 bp, Homo sapiens
  Human Epo Receptor
atggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctctta

SEQ ID NO: 963 - DNA, 564 bp, Mus musculus
  Mouse cyclinD Promoter
gcatcttcgggtgttacacagttcctgaattttacacgtgttgatgaaattgaaagaagacagggacgctgggatttctaagcaatgggtccgcctgtgggtgcctcgtggcgtactcggaaacgcacccattctcccggtttaagaacagggtgtccttgcacccccaggctccccttccatacattcttccttggcttgcgtgtggcctggcctccctcctagctgtcctcctgtccagagccgccactaccccacctccacaggtctcggaggaccctcttagggaaagaagcccccctcccccttgccccgctctttcccagtttggagagaagcagtccgagcgatttgcatatctacgaaggctgagggggaagggtttgggcttgccccccccccgccgcccccccccctcactgctcccgagccccctccccctgcacccgcctcggccctccccctcccccttttctctgcccggctttgatctctgcttaacaacagtaacgtcacacggactacaggggagttttgttgaagttgcaaagtcctgcagcctcc

SEQ ID NO: 964 - DNA, 42 bp, Artificial Sequence
  Stat5 DNA Binding Element
ctgcagtgtggacttcttggaattaagggacttttgctgcag

SEQ ID NO: 965 - protein, 19 aa, Artificial Sequence
  Mutant DsbA Leader Sequence
MKKIWLALAGLVLAFSAMA

SEQ ID NO: 966 - DNA, 56 bp, Artificial Sequence
  Forward Primer DS1
gagagagaattctaaggaggtttcaccatgaaaaagatttggctggcgctggctgg

SEQ ID NO: 967 - DNA, 56 bp, Artificial Sequence
  Forward Primer DS2
gagagagaattctaaggagtattcaccatgaaaaagatttggctggcgctggctgg

SEQ ID NO: 968 - DNA, 56 bp, Artificial Sequence
  Forward Primer DS3
gagagagaattcttaggattattcaccatgaaaaagatttggctggcgctggctgg

SEQ ID NO: 969 - DNA, 53 bp, Artificial Sequence
  Reverse Primer DM
gagagaccatggcgctaaacgctaaaactaaaccagccagcgccagccaaatc

SEQ ID NO: 970 - DNA, 62 bp, Artificial Sequence
  Reverse Primer DS
gagagaccatggccgccgatgcgctaaacgctaaaactaaaccagccagcgccagccaaatc

SEQ ID NO: 971 - DNA, 76 bp, Artificial Sequence
  DS1 RBS Variant Leader Sequence
gaattctaaggaggtttcaccatgaaaaagatttggctggcgctggctggtttagttttagcgtttagcgccatgg

SEQ ID NO: 972 - DNA, 76 bp, Artificial Sequence
  DS2 RBS Variant Leader Sequence
gaattctaaggagtattcaccatgaaaaagatttggctggcgctggctggtttagttttagcgtttagcgccatgg

SEQ ID NO: 973 - DNA, 76 bp, Artificial Sequence
  DS3 RBS Variant Leader Sequence
gaattcttaggattattcaccatgaaaaagatttggctggcgctggctggtttagttttagcgtttagcgccatgg

SEQ ID NO: 974 - DNA, 87 bp, Artificial Sequence
  DM1 RBS Variant Leader Sequence
gaattctaaggaggtttcaccatgaaaaagatttggctggcgctggctggtttagttttagcgtttagcgcatcggcggccatggca

SEQ ID NO: 975 - DNA, 87 bp, Artificial Sequence
  DM2 RBS Variant Leader Sequence
gaattctaaggagtattcaccatgaaaaagatttggctggcgctggctggtttagttttagcgtttagcgcatcggcggccatggca

SEQ ID NO: 976 - DNA, 87 bp, Artificial Sequence
  DM3 RBS Variant Leader Sequence
gaattcttaggattattcaccatgaaaaagatttggctggcgctggctggtttagttttagcgtttagcgcatcggcggccatggca

SEQ ID NO: 977 - DNA, 6 bp, Artificial Sequence
  NcoI Restriction Site
ccatgg

SEQ ID NO: 978 - DNA, 6 bp, Artificial Sequence
  NheI Restriction Site
gctagc

SEQ ID NO: 979 - DNA, 6 bp, Artificial Sequence
  AvrII Restriction Site
cctagg

SEQ ID NO: 980 - DNA, 6 bp, Artificial Sequence
  BsiWI Restriction Site
cgtacg

SEQ ID NO: 981 - protein, 5 aa, Artificial Sequence
  Linker Sequence
GGGGG

SEQ ID NO: 982 - protein, 5 aa, Artificial Sequence
  Linker Sequence
GGGGS

SEQ ID NO: 983 - protein, 5 aa, Artificial Sequence
  Linker Sequence
SSSSG

SEQ ID NO: 984 - protein, 15 aa, Artificial Sequence
  Linker Sequence
GGGGSGGGGSGGGGS

SEQ ID NO: 985 - protein, 6 aa, Artificial Sequence
  Linker Sequence
  VARIANT (6)...(6): Xaa - repeat of AA 1-5, N numbers of time
GGGGSX

SEQ ID NO: 986 - DNA, 6 bp, Artificial Sequence
  EcoRI Restriction Site
gaattc

SEQ ID NO: 987 - protein, 14 aa, Artificial Sequence
  TPO Peptide
IEGPTLRQWLAARA

SEQ ID NO: 988 - protein, 19 aa, Artificial Sequence
  TPO Peptide
GGCADGPTLREWISFCGGK

SEQ ID NO: 989 - protein, 18 aa, Artificial Sequence
  TPO Peptide
GGCADGPTLREWISFCGG

SEQ ID NO: 990 - protein, 19 aa, Artificial Sequence
  TPO Peptide
LAIEGPTLRQWLHGNGRDT

SEQ ID NO: 991 - protein, 19 aa, Artificial Sequence
  TPO Peptide
GNADGPTLRQWLEGRRPKN

SEQ ID NO: 992 - protein, 18 aa, Artificial Sequence
  TPO Peptide
TIKGPTLRQWLKSREHTS

SEQ ID NO: 993 - protein, 18 aa, Artificial Sequence
  EPO Peptide
DYHCRMGPLTWVCKPLGG

SEQ ID NO: 994 - protein, 20 aa, Artificial Sequence
  EPO Peptide
GGTYSCHFGPLTWVCKPQGG

SEQ ID NO: 995 - protein, 18 aa, Artificial Sequence
  EPO Peptide
DREGCRRGWVGQCKAWFN

SEQ ID NO: 996 - protein, 23 aa, Artificial Sequence
  EPO Peptide
QRVEILEGRTECVLSNLRGRTRY

SEQ ID NO: 997 - protein, 5 aa, Artificial Sequence
  G-CSF
EEDCK

SEQ ID NO: 998 - protein, 19 aa, Artificial Sequence
  IL-5
TGGGDGYVCVEWARCPTCK

SEQ ID NO: 999 - protein, 15 aa, Artificial Sequence
  IL-5
EGYVCVEWAACPTCR

SEQ ID NO: 1000 - protein, 17 aa, Artificial Sequence
  human brain natriuretic peptide (hBNP-32)
CFGRKMDRISSSSGLGC

SEQ ID NO: 1001 - protein, 15 aa, Artificial Sequence
  human brain natriuretic peptide (hBNP-32)
FGRKMDRISSSSGLG

SEQ ID NO: 1002 - protein, 39 aa, Artificial Sequence
  Exendin 4
HGEGRFTSDLSKQMEEEAVRLFIEWLKNGGPSSGAPPPS

SEQ ID NO: 1003 - protein, 29 aa, Artificial Sequence
  GLP-1
HAEGTFTSDVSSYLEGQMKEFIAWLVKGR

SEQ ID NO: 1004 - protein, 34 aa, Artificial Sequence
  GLP-2
HADGSFSDEMNTILDNLAARDFINWLIQTKITDR

SEQ ID NO: 1005 - protein, 29 aa, Artificial Sequence
  Glucagon
HSQGTFTSDYSKYLDSRRAQDRVQWLMNT

SEQ ID NO: 1006 - protein, 38 aa, Artificial Sequence
  PACAP-38
HSDGIFTDSYSRYRKQMAVKKYLAAVLGKRYKQRVKNK

SEQ ID NO: 1007 - protein, 33 aa, Artificial Sequence
  CD209L
RYWNSGEPNNSGNEDCAEFSGSGWNCNRCDVDN

SEQ ID NO: 1008 - protein, 11 aa, Artificial Sequence
  TNF
YCFTASENHCY

SEQ ID NO: 1009 - protein, 11 aa, Artificial Sequence
  TNF
YCFTNSENHCY

SEQ ID NO: 1010 - protein, 19 aa, Artificial Sequence
  VEGF
VEPNCDIHVMWEWECFERL

SEQ ID NO: 1011 - protein, 18 aa, Artificial Sequence
  VEGF
GERWCFDGPLTWVCGEES

SEQ ID NO: 1012 - protein, 10 aa, Artificial Sequence
  MMP inhibitor
CTTHWGFTLC

SEQ ID NO: 1013 - protein, 10 aa, Artificial Sequence
  CTLA-4
CSLHWGFWWC

SEQ ID NO: 1014 - protein, 15 aa, Artificial Sequence
  CTLA-4
GFVCSGIFAVGVGRC

SEQ ID NO: 1015 - DNA, 5450 bp, Artificial Sequence
  Plasmid A with DsbA RBS1
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattctaaggaggtttcaccatgaaaaagatttggctggcgctggctggtttagttttagcgtttagcgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 1016 - DNA, 5450 bp, Artificial Sequence
  Plasmid A with DsbA RBS2
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattctaaggagtattcaccatgaaaaagatttggctggcgctggctggtttagttttagcgtttagcgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 1017 - DNA, 5450 bp, Artificial Sequence
  Plasmid A with DsbA RBS3
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattcttaggattattcaccatgaaaaagatttggctggcgctggctggtttagttttagcgtttagcgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 1018 - DNA, 5459 bp, Artificial Sequence
  Plasmid A with mutant DsbA RBS1
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattctaaggaggtttcaccatgaaaaagatttggctggcgctggctggtttagttttagcgtttagcgcatcggcggccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 1019 - DNA, 5459 bp, Artificial Sequence
  Plasmid A with mutant DsbA RBS2
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattctaaggagtattcaccatgaaaaagatttggctggcgctggctggtttagttttagcgtttagcgcatcggcggccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 1020 - DNA, 5459 bp, Artificial Sequence
  Plasmid A with mutant DsbA RBS3
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattcttaggattattcaccatgaaaaagatttggctggcgctggctggtttagttttagcgtttagcgcatcggcggccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 1021 - DNA, 4954 bp, Artificial Sequence
  Plasmid C with DsbA RBS1
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattctaaggaggtttcaccatgaaaaagatttggctggcgctggctggtttagttttagcgtttagcgccatggcggaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacaaggcctattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtctaagaaaccattattat

SEQ ID NO: 1022 - DNA, 4954 bp, Artificial Sequence
  Plasmid C with DsbA RBS2
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattctaaggagtattcaccatgaaaaagatttggctggcgctggctggtttagttttagcgtttagcgccatggcggaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacaaggcctattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtctaagaaaccattattat

SEQ ID NO: 1023 - DNA, 4954 bp, Artificial Sequence
  Plasmid C with DsbA RBS3
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattcttaggattattcaccatgaaaaagatttggctggcgctggctggtttagttttagcgtttagcgccatggcggaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacaaggcctattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtctaagaaaccattattat

SEQ ID NO: 1024 - DNA, 4963 bp, Artificial Sequence
  Plasmid C with mutant DsbA RBS1
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattctaaggaggtttcaccatgaaaaagatttggctggcgctggctggtttagttttagcgtttagcgcatcggcggccatggcggaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacaaggcctattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtctaagaaaccattattat

SEQ ID NO: 1025 - DNA, 4963 bp, Artificial Sequence
  Plasmid C with mutant DsbA RBS2
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattctaaggagtattcaccatgaaaaagatttggctggcgctggctggtttagttttagcgtttagcgcatcggcggccatggcggaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacaaggcctattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtctaagaaaccattattat

SEQ ID NO: 1026 - DNA, 4963 bp, Artificial Sequence
  Plasmid C with mutant DsbA RBS3
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattcttaggattattcaccatgaaaaagatttggctggcgctggctggtttagttttagcgtttagcgcatcggcggccatggcggaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacaaggcctattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtctaagaaaccattattat

SEQ ID NO: 1027 - protein, 121 aa, Artificial Sequence [sequence omitted]

SEQ ID NO: 1028 - protein, 119 aa, Artificial Sequence
  Erbitux Heavy Chain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 1029 - protein, 120 aa, Artificial Sequence [sequence omitted]

SEQ ID NO: 1030 - protein, 123 aa, Artificial Sequence [sequence omitted]

SEQ ID NO: 1031 - protein, 123 aa, Artificial Sequence [sequence omitted]

SEQ ID NO: 1032 - protein, 121 aa, Artificial Sequence
  Campath Heavy Chain
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSS

SEQ ID NO: 1033 - protein, 121 aa, Artificial Sequence [sequence omitted]

SEQ ID NO: 1034 - protein, 118 aa, Artificial Sequence
  Vectibix Heavy Chain
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTSS

SEQ ID NO: 1035 - protein, 106 aa, Artificial Sequence [sequence omitted]

SEQ ID NO: 1036 - protein, 107 aa, Artificial Sequence
  Erbitux Light Chain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 1037 - protein, 107 aa, Artificial Sequence [sequence omitted]

SEQ ID NO: 1038 - protein, 107 aa, Artificial Sequence [sequence omitted]

SEQ ID NO: 1039 - protein, 107 aa, Artificial Sequence [sequence omitted]

SEQ ID NO: 1040 - protein, 107 aa, Artificial Sequence
  Campath Light Chain
DIQMTQSPSSLSASVGDRVTITCKASQNIDKYLNWYQQKPGKAPKLLIYNTNNLQTGVPSRFSGSGSGTDFTFTISSLQPEDIATYYCLQHISRPRTFGQGTKVEIK

SEQ ID NO: 1041 - protein, 107 aa, Artificial Sequence [sequence omitted]

SEQ ID NO: 1042 - protein, 107 aa, Artificial Sequence [sequence omitted]

SEQ ID NO: 1043 - DNA, 363 bp, Artificial Sequence
  Rituxan Heavy Chain
caggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgca

SEQ ID NO: 1044 - DNA, 357 bp, Artificial Sequence
  Erbitux Heavy Chain
caggtgcagctgaagcagtcaggacctggcctagtgcagccctcacagagcctgtccatcacctgcacagtctctggtttctcattaactaactatggtgtacactgggttcgccagtctccaggaaagggtctggagtggctgggagtgatatggagtggtggaaacacagactataatacacctttcacatccagactgagcatcaacaaggacaattccaagagccaagttttctttaaaatgaacagtctgcaatctaatgacacagccatatattactgtgccagagccctcacctactatgattacgagtttgcttactggggccaagggactctggtcactgtctctgca

SEQ ID NO: 1045 - DNA, 369 bp, Artificial Sequence
  Avastin Heavy Chain
gaggttcagctggtggagtctggcggtggcctggtgcagccagggggctcactccgtttgtcctgtgcagcttctggctacacctttaccaactacggtatgaactgggtgcgtcaggccccaggtaagggcctggaatgggttggatggattaatacttatacaggtgagcccacctatgccgcggacttcaagcgtcgtttcacgttctccctcgatacatccaaatccacagcctacctgcaaatgaacagcctgcgtgctgaggacactgccgtctattattgtgctaagtacccacactactacggctccagccactggtattttgacgtctggggtcaaggaaccctggtcaccgtctcctcg

SEQ ID NO: 1046 - DNA, 369 bp, Artificial Sequence
  Lucentis Heavy Chain
gaggttcagctggtggagtctggcggtggcctggtgcagccagggggctcactccgtttgtcctgtgcagcttctggctacgactttacccactacggtatgaactgggtgcgtcaggccccaggtaagggcctggaatgggttggatggattaatacttatacaggtgagcccacctatgccgcggacttcaagcgtcgtttcacgttctccctcgatacatccaaatccacagcctacctgcaaatgaacagcctgcgtgctgaggacactgccgtctattattgtgctaagtacccatattactacggcactagccactggtattttgacgtctggggtcaaggaaccctggtcaccgtctcctcg

SEQ ID NO: 1047 - DNA, 363 bp, Artificial Sequence
  Campath Heavy Chain
caggtccaactgcaggagagcggtccaggtcttgtgagacctagccagaccctgagcctgacctgcaccgtgtctggcttcaccttcaccgatttctacatgaactgggtgagacagccacctggacgaggtcttgagtggattggatttattagagacaaagctaaaggttacacaacagagtacaatccatctgtgaaggggagagtgacaatgctggtagacaccagcaagaaccagttcagcctgagactcagcagcgtgacagccgccgacaccgcggtctattattgtgcaagagagggccacactgctgctccttttgattactggggtcaaggcagcctcgtcacagtctcctca

SEQ ID NO: 1048 - DNA, 363 bp, Artificial Sequence
  Humira Heavy Chain
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcagctattatctggaatagtggtcacatagactatgcggactctgtggagggccgattcaccatctccagagacaacgccaagaactccctgtatctgcaaatgaacagtctgagagctgaggacacggccgtgtattactgtgcaaaagtttcctacctcagtaccgcttcatcccttgactactggggccagggaaccctggtcaccgtctcctca

SEQ ID NO: 1049 - DNA, 354 bp, Artificial Sequence
  Vectibix Heavy Chain
caggtgcagctgcaggagtcgggcccaggactggtgaagccttcggagaccctgtccctcacctgcactgtctctggtggctccgtcagtagtggagactactactggacctggatccggcagtccccagggaagggactggagtggattgggcatatctattacagtgggaacaccaactacaacccctccctcaagagtcgactcaccatatcaatagacacgtccaagacccagttctccctgaagctgagctctgtgaccgctgcggacacggccatctattactgtgtgagggaccgagtcactggtgcttttgatatctggggccaagggacaatggtcacctcatct

SEQ ID NO: 1050 - DNA, 318 bp, Artificial Sequence
  Rituxan Light Chain
caaattgttctctcccagtctccagcaatcctgtctgcatctccaggggagaaggtcacaatgacttgcagggccagctcaagtgtaagttacatccactggttccagcagaagccaggatcctcccccaaaccctggatttatgccacatccaacctggcttctggagtccctgttcgcttcagtggcagtgggtctgggacttcttactctctcacaatcagcagagtggaggctgaagatgctgccacttattactgccagcagtggactagtaacccacccacgttcggaggggggaccaagctggaaatcaaa

SEQ ID NO: 1051 - DNA, 318 bp, Artificial Sequence; identical to SEQ ID NO: 1050
  Erbitux Light Chain

SEQ ID NO: 1052 - DNA, 321 bp, Artificial Sequence
  Avastin Light Chain
gatatccagatgacccagtccccgagctccctgtccgcctctgtgggcgatagggtcaccatcacctgtagtgccagtcaggacatcagtaattatctcaactggtatcaacagaaaccaggaaaagctccgaaagtgctgatttactttacctccagcctgcactctggagtcccttctcgcttctctggttctggttctgggacggatttcactctgaccatcagcagtctgcaaccggaggacttcgcaacttattactgtcagcaatatagtactgtgccgtggacgttcggacagggcaccaaggtggagatcaaa

SEQ ID NO: 1053 - DNA, 321 bp, Artificial Sequence
  Lucentis Light Chain
gacatccagctgacccagtctccatcctccctgtctgcatctgtaggagacagagtcaccatcacttgcagcgcaagtcaggacattagcaactatttaaattggtatcagcagaaaccagggaaagcccctaaggtcctgatctattttacatccagtttgcacagtggggtcccatcaaggttcagtggcagtggatctgggacagatttcactctcaccatcagcagtctgcaacctgaagattttgcaacttactactgtcaacagtattccactgtcccgtggacgttcggccaagggaccaaggtggaaatcaaa

SEQ ID NO: 1054 - DNA, 321 bp, Artificial Sequence
  Campath Light Chain
gacatccagatgacccagagcccaagcagcctgagcgccagcgtgggtgacagagtgaccatcacctgtaaagcaagtcagaatattgacaaatacttaaactggtaccagcagaagccaggtaaggctccaaagctgctgatctacaatacaaacaatttgcaaacgggtgtgccaagcagattcagcggtagcggtagcggtaccgacttcaccttcaccatcagcagcctccagccagaggacatcgccacctactactgcttgcagcatataagtaggccgcgcacgttcggccaagggaccaaggtggaaatcaaa

SEQ ID NO: 1055 - DNA, 321 bp, Artificial Sequence
  Humira Light Chain
gacatccagatgacccagtctccatcctccctgtctgcatctgtaggagacagagtcaccatcacttgccgggcgagtcagggcattaggaattatttagcctggtatcagcagaaaccagggaaagctcctaaactcctgatctatgctgcatccactttgcaatcaggggtcccatctcggttcagcggcagtggatctgggacagatttcactctcaccatcagcagcctgcagcctgaagatgttgcaacttattactgtcaaaggtataacagagccccgtacacttttggccaggggaccaaggtggagatcaaa

SEQ ID NO: 1056 - DNA, 321 bp, Artificial Sequence
  Vectibix Light Chain
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatatttctgtcaacactttgatcatctccctctcgctttcggcggagggaccaaggtggagatcaaa

SEQ ID NO: 1057 - DNA, 360 bp, Artificial Sequence
  gnl|Fabrus|HerceptinHC
aaggtgcagctggttgaaagcggcggcggtctggtgcagccgggcggtagcctgcgcctgagctgcgcggcgagcggctttaacattaaagatacctatattcattgggtgcgccaggcgccgggtaaaggcctggaatgggtggcgcgcatttatccgaccaatggttatacccgttatgcggatagcgtgaaaggtcgttttaccatcagcgcggataccagcaaaaacaccgcctatctgcagatgaatagcctgcgcgcggaagataccgcggtgtattattgtagccgttggggcggcgatggcttttatgcgatggattattggggccagggcaccctggtgaccgtgagcagc

SEQ ID NO: 1058 - DNA, 363 bp, Artificial Sequence
  gnl|Fabrus|Anti-CD20 HC
caggcctacctgcagcagagcggcgccgagctggtgaggcccggcgccagcgtgaagatgagctgcaaggccagcggctacaccttcaccagctacaacatgcactgggtgaagcagacccccaggcagggcctggagtggatcggcgccatctaccccggcaacggcgacaccagctacaaccagaagttcaagggcaaggccaccctgaccgtggacaagagcagcagcaccgcctacatgcagctgagcagcctgaccagcgaggacagcgccgtgtacttctgcgccagggtggtgtactacagcaacagctactggtacttcgacgtgtggggcaccggcaccaccgtgaccgtgagc

SEQ ID NO: 1059 - DNA, 367 bp, Artificial Sequence
  gnl|Fabrus|VH1-18_IGHD1-26*01_IGHJ2*01
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagggtatagtgggagctactactactggtacttcgatctctggggccgtggcaccctggtcactgtctcctcag

SEQ ID NO: 1060 - DNA, 376 bp, Artificial Sequence
  gnl|Fabrus|VH1-18_IGHD2-21*01_IGHJ2*01
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagaagcatattgtggtggtgattgctattcctactggtacttcgatctctggggccgtggcaccctggtcactgtctcctcag

SEQ ID NO: 1061 - DNA, 397 bp, Artificial Sequence
  gnl|Fabrus|VH1-18_IGHD3-16*01_IGHJ6*01
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagagtattatgattacgtttgggggagttatgcttataccgattactactactactacggtatggacgtctgggggcaagggaccacggtcaccgtctcctcag

SEQ ID NO: 1062 - DNA, 376 bp, Artificial Sequence
  gnl|Fabrus|VH1-18_IGHD3-22*01_IGHJ4*01
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagagtattactatgatagtagtggttattactacgactactttgactactggggccaaggaaccctggtcaccgtctcctcag

SEQ ID NO: 1063 - DNA, 367 bp, Artificial Sequence
  gnl|Fabrus|VH1-18_IGHD4-23*01_IGHJ1*01
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagatgactacggtggtaactccgctgaatacttccagcactggggccagggcaccctggtcaccgtctcctcag

SEQ ID NO: 1064 - DNA, 367 bp, Artificial Sequence
  gnl|Fabrus|VH1-18_IGHD5-12*01_IGHJ4*01
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagaggtggatatagtggctacgattacgactactttgactactggggccaaggaaccctggtcaccgtctcctcag

SEQ ID NO: 1065 - DNA, 367 bp, Artificial Sequence
  gnl|Fabrus|VH1-18_IGHD6-6*01_IGHJ1*01
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagaggagtatagcagctcgtccgctgaatacttccagcactggggccagggcaccctggtcaccgtctcctcag

SEQ ID NO: 1066 - DNA, 361 bp, Artificial Sequence
  gnl|Fabrus|VH1-2_IGHD1-1*01_IGHJ3*01
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagggtacaactggaacgacgatgcttttgatgtctggggccaagggacaatggtcaccgtctcttcag

SEQ ID NO: 1067 - DNA, 361 bp, Artificial Sequence
  gnl|Fabrus|VH1-24_IGHD1-7*01_IGHJ4*01
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagggtataactggaactacgactactttgactactggggccaaggaaccctggtcaccgtctcctcag

SEQ ID NO: 1068 - DNA, 379 bp, Artificial Sequence
  gnl|Fabrus|VH1-24_IGHD2-15*01_IGHJ2*01
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagaaggatattgtagtggtggtagctgctactcctactggtacttcgatctctggggccgtggcaccctggtcactgtctcctcag

SEQ ID NO: 1069 - DNA, 376 bp, Artificial Sequence
  gnl|Fabrus|VH1-24_IGHD3-10*01_IGHJ4*01
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagagtattactatggttcggggagttattataacgactactttgactactggggccaaggaaccctggtcaccgtctcctcag

SEQ ID NO: 1070 - DNA, 382 bp, Artificial Sequence
  gnl|Fabrus|VH1-24_IGHD3-16*01_IGHJ4*01
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagagtattatgattacgtttgggggagttatgcttataccgactactttgactactggggccaaggaaccctggtcaccgtctcctcag

SEQ ID NO: 1071 - DNA, 367 bp, Artificial Sequence
  gnl|Fabrus|VH1-24_IGHD4-23*01_IGHJ2*01
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagatgactacggtggtaactcctactggtacttcgatctctggggccgtggcaccctggtcactgtctcctcag

SEQ ID NO: 1072 - DNA, 367 bp, Artificial Sequence
  gnl|Fabrus|VH1-24_IGHD5-12*01_IGHJ4*01
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacaggtggatatagtggctacgattacgactactttgactactggggccaaggaaccctggtcaccgtctcctcag

SEQ ID NO: 1073 - DNA, 379 bp, Artificial Sequence
  gnl|Fabrus|VH1-24_IGHD5-18*01_IGHJ6*01
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacaggtggatacagctatggttacgattactactactactacggtatggacgtctgggggcaagggaccacggtcaccgtctcctcag

SEQ ID NO: 1074 - DNA, 367 bp, Artificial Sequence
  gnl|Fabrus|VH1-24_IGHD6-19*01_IGHJ4*01
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagaggggtatagcagtggctggtacgactactttgactactggggccaaggaaccctggtcaccgtctcctcag

SEQ ID NO: 1075 - DNA, 379 bp, Artificial Sequence
  gnl|Fabrus|VH1-3_IGHD2-15*01_IGHJ2*01
caggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagaaggatattgtagtggtggtagctgctactcctactggtacttcgatctctggggccgtggcaccctggtcactgtctcctcag

SEQ ID NO: 1076 - DNA, 379 bp, Artificial Sequence
  gnl|Fabrus|VH1-3_IGHD2-2*01_IGHJ5*01
caggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagaaggatattgtagtagtaccagctgctatgccgacaactggttcgactcctggggccaaggaaccctggtcaccgtctcctcag

SEQ ID NO: 1077 - DNA, 391 bp, Artificial Sequence
  gnl|Fabrus|VH1-3_IGHD3-9*01_IGHJ6*01
caggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagagtattacgatattttgactggttattataacgattactactactactacggtatggacgtctgggggcaagggaccacggtcaccgtctcctcag

SEQ ID NO: 1078 - DNA, 364 bp, Artificial Sequence
  gnl|Fabrus|VH1-3_IGHD4-23*01_IGHJ4*01
caggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagatgactacggtggtaactccgactactttgactactggggccaaggaaccctggtcaccgtctcctcag

SEQ ID NO: 1079 - DNA, 364 bp, Artificial Sequence
  gnl|Fabrus|VH1-3_IGHD4-23*01_IGHJ4*01
caggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagaggtggatacagctatggttacgactactttgactactggggccaaggaaccctggtcaccgtctcctcag

SEQ ID NO: 1080 - DNA, 367 bp, Artificial Sequence
  gnl|Fabrus|VH1-3_IGHD6-6*01_IGHJ1*01
caggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagaggagtatagcagctcgtccgctgaatacttccagcactggggccagggcaccctggtcaccgtctcctcag

SEQ ID NO: 1081 - DNA, 355 bp, Artificial Sequence
  gnl|Fabrus|VH1-3_IGHD7-27*01_IGHJ4*01
caggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagctaactggggagactactttgactactggggccaaggaaccctggtcaccgtctcctcag

SEQ ID NO: 1082 - DNA, 364 bp, Artificial Sequence
  gnl|Fabrus|VH1-45_IGHD1-26*01_IGHJ4*01
cagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatggtatagtgggagctactacgactactttgactactggggccaaggaaccctggtcaccgtctcctcag

SEQ ID NO: 1083 - DNA, 391 bp, Artificial Sequence
  gnl|Fabrus|VH1-45_IGHD2-15*01_IGHJ6*01
cagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatatggatattgtagtggtggtagctgctactccgattactactactactacggtatggacgtctgggggcaagggaccacggtcaccgtctcctcag

SEQ ID NO: 1084 - DNA, 376 bp, Artificial Sequence
  gnl|Fabrus|VH1-45_IGHD2-8*01_IGHJ3*01
cagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatatggatattgtactaatggtgtatgctataccgatgcttttgatgtctggggccaagggacaatggtcaccgtctcttcag

SEQ ID NO: 1085 - DNA, 376 bp, Artificial Sequence
  gnl|Fabrus|VH1-45_IGHD3-10*01_IGHJ4*01
cagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatattattactatggttcggggagttattataacgactactttgactactggggccaaggaaccctggtcaccgtctcctcag

SEQ ID NO: 1086 - DNA, 385 bp, Artificial Sequence
  gnl|Fabrus|VH1-45_IGHD3-16*01_IGHJ2*01
cagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatattattatgattacgtttgggggagttatgcttatacctactggtacttcgatctctggggccgtggcaccctggtcactgtctcctcag

SEQ ID NO: 1087 - DNA, 364 bp, Artificial Sequence
  gnl|Fabrus|VH1-45_IGHD4-23*01_IGHJ4*01
cagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatatgactacggtggtaactccgactactttgactactggggccaaggaaccctggtcaccgtctcctcag

SEQ ID NO: 1088 - DNA, 364 bp, Artificial Sequence
  gnl|Fabrus|VH1-45_IGHD5-24*01_IGHJ4*01
cagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatgtagagatggctacaattacgactactttgactactggggccaaggaaccctggtcaccgtctcctcag

SEQ ID NO: 1089 - DNA, 367 bp, Artificial Sequence
  gnl|Fabrus|VH1-45_IGHD6-19*01_IGHJ4*01
cagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatatgggtatagcagtggctggtacgactactttgactactggggccaaggaaccctggtcaccgtctcctcag

SEQ ID NO: 1090 - DNA, 370 bp, Artificial Sequence
  gnl|Fabrus|VH1-45_IGHD7-27*01_IGHJ6*01
cagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatctaactggggagattactactactactacggtatggacgtctgggggcaagggaccacggtcaccgtctcctcag

SEQ ID NO: 1091 - DNA, 364 bp, Artificial Sequence
  gnl|Fabrus|VH1-46_IGHD1-26*01_IGHJ4*01
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagggtatagtgggagctactacgactactttgactactggggccaaggaaccctggtcaccgtctcctcag

SEQ ID NO: 1092 - DNA, 379 bp, Artificial Sequence
  gnl|Fabrus|VH1-46_IGHD2-15*01_IGHJ2*01
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaaggatattgtagtggtggtagctgctactcctactggtacttcgatctctggggccgtggcaccctggtcactgtctcctcag

SEQ ID NO: 1093 - DNA, 376 bp, Artificial Sequence
  gnl|Fabrus|VH1-46_IGHD3-10*01_IGHJ4*01
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagagtattactatggttcggggagttattataacgactactttgactactggggccaaggaaccctggtcaccgtctcctcag

SEQ ID NO: 1094 - DNA, 361 bp, Artificial Sequence
  gnl|Fabrus|VH1-46_IGHD4-17*01_IGHJ4*01
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagatgactacggtgactacgactactttgactactggggccaaggaaccctggtcaccgtctcctcag

SEQ ID NO: 1095 - DNA, 364 bp, Artificial Sequence
  gnl|Fabrus|VH1-46_IGHD5-18*01_IGHJ4*01
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaggtggatacagctatggttacgactactttgactactggggccaaggaaccctggtcaccgtctcctcag

SEQ ID NO: 1096 - DNA, 367 bp, Artificial Sequence
  gnl|Fabrus|VH1-46_IGHD6-13*01_IGHJ4*01
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggggtatagcagcagctggtacgactactttgactactggggccaaggaaccctggtcaccgtctcctcag

SEQ ID NO: 1097 - DNA, 367 bp, Artificial Sequence
  gnl|Fabrus|VH1-46_IGHD6-6*01_IGHJ1*01
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggagtatagcagctcgtccgctgaatacttccagcactggggccagggcaccctggtcaccgtctcctcag

SEQ ID NO: 1098 - DNA, 358 bp, Artificial Sequence
  gnl|Fabrus|VH1-46_IGHD7-27*01_IGHJ2*01
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagctaactggggatactggtacttcgatctctggggccgtggcaccctggtcactgtctcctcag

SEQ ID NO: 1099 - DNA, 364 bp, Artificial Sequence
  gnl|Fabrus|VH1-58_IGHD1-26*01_IGHJ4*01
caaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagggtatagtgggagctactacgactactttgactactggggccaaggaaccctggtcaccgtctcctcag

SEQ ID NO: 1100 - DNA, 379 bp, Artificial Sequence
  gnl|Fabrus|VH1-58_IGHD2-15*01_IGHJ2*01
caaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagaaggatattgtagtggtggtagctgctactcctactggtacttcgatctctggggccgtggcaccctggtcactgtctcctcag

SEQ ID NO: 1101 - DNA, 391 bp, Artificial Sequence
  gnl|Fabrus|VH1-58_IGHD3-10*01_IGHJ6*01
caaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagagtattactatggttcggggagttattataacgattactactactactacggtatggacgtctgggggcaagggaccacggtcaccgtctcctcag

SEQ ID NO: 1102 - DNA, 361 bp, Artificial Sequence
  gnl|Fabrus|VH1-58_IGHD4-17*01_IGHJ4*01
caaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagatgactacggtgactacgactactttgactactggggccaaggaaccctggtcaccgtctcctcag

SEQ ID NO: 1103 - DNA, 364 bp, Artificial Sequence
  gnl|Fabrus|VH1-58_IGHD5-18*01_IGHJ4*01
caaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcaggtggatacagctatggttacgactactttgactactggggccaaggaaccctggtcaccgtctcctcag

SEQ ID NO: 1104 - DNA, 367 bp, Artificial Sequence
  gnl|Fabrus|VH1-58_IGHD6-6*01_IGHJ1*01
caaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagaggagtatagcagctcgtccgctgaatacttccagcactggggccagggcaccctggtcaccgtctcctcag

SEQ ID NO: 1105 - DNA, 358 bp, Artificial Sequence
  gnl|Fabrus|VH1-58_IGHD7-27*01_IGHJ5*01
caaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagctaactggggagacaactggttcgactcctggggccaaggaaccctggtcaccgtctcctcag

SEQ ID NO: 1106 - DNA, 376 bp, Artificial Sequence
  gnl|Fabrus|VH1-69_IGHD1-1*01_IGHJ6*01
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagggtacaactggaacgacgattactactactactacggtatggacgtctgggggcaagggaccacggtcaccgtctcctcag

SEQ ID NO: 1107 - DNA, 361 bp, Artificial Sequence
  gnl|Fabrus|VH1-69_IGHD1-14*01_IGHJ4*01
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagggtataaccggaaccacgactactttgactactggggccaaggaaccctggtcaccgtctcctcag

SEQ ID NO: 1108 - DNA, 376 bp, Artificial Sequence
  gnl|Fabrus|VH1-69_IGHD2-2*01_IGHJ4*01
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagaaggatattgtagtagtaccagctgctatgccgactactttgactactggggccaaggaaccctggtcaccgtctcctcag

SEQ ID NO: 1109 - DNA, 391 bp, Artificial Sequence
  gnl|Fabrus|VH1-69_IGHD2-8*01_IGHJ6*01
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagaaggatattgtactaatggtgtatgctataccgattactactactactacggtatggacgtctgggggcaagggaccacggtcaccgtctcctcag

SEQ ID NO: 1110 - DNA, 382 bp, Artificial Sequence
  gnl|Fabrus|VH1-69_IGHD3-16*01_IGHJ4*01
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagagtattatgattacgtttgggggagttatgcttataccgactactttgactactggggccaaggaaccctggtcaccgtctcctcag

SEQ ID NO: 1111 - DNA, 376 bp, Artificial Sequence
  gnl|Fabrus|VH1-69_IGHD3-3*01_IGHJ4*01
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagagtattacgatttttggagtggttattataccgactactttgactactggggccaaggaaccctggtcaccgtctcctcag

SEQ ID NO: 1112 - DNA, 391 bp, Artificial Sequence
  gnl|Fabrus|VH1-69_IGHD3-9*01_IGHJ6*01
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagagtattacgatattttgactggttattataacgattactactactactacggtatggacgtctgggggcaagggaccacggtcaccgtctcctcag

SEQ ID NO: 1113 - DNA, 361 bp, Artificial Sequence
  gnl|Fabrus|VH1-69_IGHD4-17*01_IGHJ4*01
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagatgactacggtgactacgactactttgactactggggccaaggaaccctggtcaccgtctcctcag

SEQ ID NO: 1114 - DNA, 367 bp, Artificial Sequence
  gnl|Fabrus|VH1-69_IGHD5-12*01_IGHJ4*01
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagaggtggatatagtggctacgattacgactactttgactactggggccaaggaaccctggtcaccgtctcctcag

SEQ ID NO: 1115 - DNA, 379 bp, Artificial Sequence
  gnl|Fabrus|VH1-69_IGHD5-24*01_IGHJ6*01
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagaggtagagatggctacaattacgattactactactactacggtatggacgtctgggggcaagggaccacggtcaccgtctcctcag

SEQ ID NO: 1116 - DNA, 367 bp, Artificial Sequence
  gnl|Fabrus|VH1-69_IGHD6-19*01_IGHJ4*01
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagaggggtatagcagtggctggtacgactactttgactactggggccaaggaaccctggtcaccgtctcctcag

SEQ ID NO: 1117 - DNA, 367 bp, Artificial Sequence
  gnl|Fabrus|VH1-69_IGHD6-6*01_IGHJ1*01
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagaggagtatagcagctcgtccgctgaatacttccagcactggggccagggcaccctggtcaccgtctcctcag

SEQ ID NO: 1118 - DNA, 355 bp, Artificial Sequence
  gnl|Fabrus|VH1-69_IGHD7-27*01_IGHJ4*01
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagagctaactggggactactttgactactggggccaaggaaccctggtcaccgtctcctcag

SEQ ID NO: 1119 - DNA, 364 bp, Artificial Sequence
  gnl|Fabrus|VH1-8_IGHD1-26*01_IGHJ4*01
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagagggtatagtgggagctactacgactactttgactactggggccaaggaaccctggtcaccgtctcctcag

SEQ ID NO: 1120 - DNA, 391 bp, Artificial Sequence
  gnl|Fabrus|VH1-8_IGHD2-15*01_IGHJ6*01
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggaggatattgtagtggtggtagctgctactccgattactactactactacggtatggacgtctgggggcaagggaccacggtcaccgtctcctcag

SEQ ID NO: 1121 - DNA, 391 bp, Artificial Sequence
  gnl|Fabrus|VH1-8_IGHD2-2*01_IGHJ6*01
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggaggatattgtagtagtaccagctgctatgccgattactactactactacggtatggacgtctgggggcaagggaccacggtcaccgtctcctcag

SEQ ID NO: 1122 - DNA, 376 bp, Artificial Sequence
  gnl|Fabrus|VH1-8_IGHD3-10*01_IGHJ4*01
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagagggtattactatggttcggggagttattataacgactactttgactactggggccaaggaaccctggtcaccgtctcctcag

SEQ ID NO: 1123 - DNA, 361 bp, Artificial Sequence
  gnl|Fabrus|VH1-8_IGHD4-17*01_IGHJ4*01
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggtgactacggtgactacgactactttgactactggggccaaggaaccctggtcaccgtctcctcag

SEQ ID NO: 1124 - DNA, 364 bp, Artificial Sequence
  gnl|Fabrus|VH1-8_IGHD5-5*01_IGHJ4*01
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggtggatacagctatggttacgactactttgactactggggccaaggaaccctggtcaccgtctcctcag

SEQ ID NO: 1125 - DNA, 355 bp, Artificial Sequence
  gnl|Fabrus|VH1-8_IGHD7-27*01_IGHJ4*01
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagagctaactggggagactactttgactactggggccaaggaaccctggtcaccgtctcctcag

SEQ ID NO: 1126 - DNA, 367 bp, Artificial Sequence
  gnl|Fabrus|VH2-26_IGHD1-20*01_IGHJ4*01
caggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacggtataactggaacgacgactactttgactactggggccaaggaaccctggtcaccgtctcctcag

SEQ ID NO: 1127 - DNA, 385 bp, Artificial Sequence
  gnl|Fabrus|VH2-26_IGHD2-15*01_IGHJ2*01
caggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacgaggatattgtagtggtggtagctgctactcctactggtacttcgatctctggggccgtggcaccctggtcactgtctcctcag

SEQ ID NO: 1128 - DNA, 382 bp, Artificial Sequence
  gnl|Fabrus|VH2-26_IGHD2-2*01_IGHJ4*01
caggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacgaggatattgtagtagtaccagctgctatgccgactactttgactactggggccaaggaaccctggtcaccgtctcctcag

SEQ ID NO: 1129 - DNA, 382 bp, Artificial Sequence
  gnl|Fabrus|VH2-26_IGHD3-10*01_IGHJ4*01
caggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacggtattactatggttcggggagttattataacgactactttgactactggggccaaggaaccctggtcaccgtctcctcag

SEQ ID NO: 1130 - DNA, 397 bp, Artificial Sequence
  gnl|Fabrus|VH2-26_IGHD3-9*01_IGHJ6*01
caggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacggtattacgatattttgactggttattataacgattactactactactacggtatggacgtctgggggcaagggaccacggtcaccgtctcctcag

SEQ ID NO: 1131 - DNA, 367 bp, Artificial Sequence
  gnl|Fabrus|VH2-26_IGHD4-11*01_IGHJ4*01
caggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacgtgactacagtaactacgactactttgactactggggccaaggaaccctggtcaccgtctcctcag

SEQ ID NO: 1132 - DNA, 373 bp, Artificial Sequence
  gnl|Fabrus|VH2-26_IGHD5-12*01_IGHJ4*01
caggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacgtggatatagtggctacgattacgactactttgactactggggccaaggaaccctggtcaccgtctcctcag

SEQ ID NO: 1133 - DNA, 370 bp, Artificial Sequence
  gnl|Fabrus|VH2-26_IGHD5-18*01_IGHJ4*01
caggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacgtggatacagctatggttacgactactttgactactggggccaaggaaccctggtcaccgtctcctcag

SEQ ID NO: 1134 - DNA, 370 bp, Artificial Sequence
  gnl|Fabrus|VH2-26_IGHD6-13*01_IGHJ4*01
caggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatagggtatagcagcagctggtacgactactttgactactggggccaaggaaccctggtcaccgtctcctcag

SEQ ID NO: 1135 - DNA, 358 bp, Artificial Sequence
  gnl|Fabrus|VH2-26_IGHD7-27*01_IGHJ4*01
caggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatactaactggggactactttgactactggggccaaggaaccctggtcaccgtctcctcag

SEQ ID NO: 1136 - DNA, 361 bp, Artificial Sequence
  gnl|Fabrus|VH2-26_IGHD7-27*01_IGHJ4*01
caggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacctaactggggagactactttgactactggggccaaggaaccctggtcaccgtctcctcag

SEQ ID NO: 1137 - DNA, 370 bp, Artificial Sequence
  gnl|Fabrus|VH2-5_IGHD1-1*01_IGHJ5*01
cagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacggtacaactggaacgacgacaactggttcgactcctggggccaaggaaccctggtcaccgtctcctcag

SEQ ID NO: 1138 - DNA, 397 bp, Artificial Sequence
  gnl|Fabrus|VH2-5_IGHD2-15*01_IGHJ6*01
cagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacgaggatattgtagtggtggtagctgctactccgattactactactactacggtatggacgtctgggggcaagggaccacggtcaccgtctcctcag

SEQ ID NO: 1139 - DNA, 388 bp, Artificial Sequence
  gnl|Fabrus|VH2-5_IGHD3-16*01_IGHJ4*01
cagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacggtattatgattacgtttgggggagttatgcttataccgactactttgactactggggccaaggaaccctggtcaccgtctcctcag

SEQ ID NO: 1140 - DNA, 397 bp, Artificial Sequence
  gnl|Fabrus|VH2-5_IGHD3-9*01_IGHJ6*01
cagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacggtattacgatattttgactggttattataacgattactactactactacggtatggacgtctgggggcaagggaccacggtcaccgtctcctcag

SEQ ID NO: 1141 - DNA, 373 bp, Artificial Sequence
  gnl|Fabrus|VH2-5_IGHD5-12*01_IGHJ4*01
cagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacgtggatatagtggctacgattacgactactttgactactggggccaaggaaccctggtcaccgtctcctcag

SEQ ID NO: 1142 - DNA, 370 bp, Artificial Sequence
  gnl|Fabrus|VH2-5_IGHD6-13*01_IGHJ4*01
cagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagagggtatagcagcagctggtacgactactttgactactggggccaaggaaccctggtcaccgtctcctcag

SEQ ID NO: 1143 - DNA, 364 bp, Artificial Sequence
  gnl|Fabrus|VH2-5_IGHD7-27*01_IGHJ2*01
cagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacctaactggggatactggtacttcgatctctggggccgtggcaccctggtcactgtctcctcag

SEQ ID NO: 1144 - DNA, 370 bp, Artificial Sequence
  gnl|Fabrus|VH2-70_IGHD1-1*01_IGHJ2*01
caggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacggtacaactggaacgactactggtacttcgatctctggggccgtggcaccctggtcactgtctcctcag

SEQ ID NO: 1145 - DNA, 385 bp, Artificial Sequence
  gnl|Fabrus|VH2-70_IGHD2-15*01_IGHJ2*01
caggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacgaggatattgtagtggtggtagctgctactcctactggtacttcgatctctggggccgtggcaccctggtcactgtctcctcag

SEQ ID NO: 1146 - DNA, 382 bp, Artificial Sequence
  gnl|Fabrus|VH2-70_IGHD3-22*01_IGHJ4*01
caggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacggtattactatgatagtagtggttattactacgactactttgactactggggccaaggaaccctggtcaccgtctcctcag

SEQ ID NO: 1147 - DNA, 397 bp, Artificial Sequence
  gnl|Fabrus|VH2-70_IGHD3-9*01_IGHJ6*01
caggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacggtattacgatattttgactggttattataacgattactactactactacggtatggacgtctgggggcaagggaccacggtcaccgtctcctcag

SEQ ID NO: 1148 - DNA, 373 bp, Artificial Sequence
  gnl|Fabrus|VH2-70_IGHD5-12*01_IGHJ4*01
caggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacgtggatatagtggctacgattacgactactttgactactggggccaaggaaccctggtcaccgtctcctcag

SEQ ID NO: 1149 - DNA, 364 bp, Artificial Sequence
  gnl|Fabrus|VH2-70_IGHD7-27*01_IGHJ2*01
caggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacctaactggggatactggtacttcgatctctggggccgtggcaccctggtcactgtctcctcag

SEQ ID NO: 1150 - DNA, 364 bp, Artificial Sequence
  gnl|Fabrus|VH3-11_IGHD1-26*01_IGHJ4*01
caggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagggtatagtgggagctactacgactactttgactactggggccaaggaaccctggtcaccgtctcctcag

SEQ ID NO: 1151 - DNA, 391 bp, Artificial Sequence
  gnl|Fabrus|VH3-11_IGHD2-2*01_IGHJ6*01
caggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagaaggatattgtagtagtaccagctgctatgccgattactactactactacggtatggacgtctgggggcaagggaccacggtcaccgtctcctcag

SEQ ID NO: 1152 - DNA, 382 bp, Artificial Sequence
  gnl|Fabrus|VH3-11_IGHD3-16*01_IGHJ4*01
caggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagagtattatgattacgtttgggggagttatgcttataccgactactttgactactggggccaaggaaccctggtcaccgtctcctcag

SEQ ID NO: 1153 - DNA, 391 bp, Artificial Sequence
  gnl|Fabrus|VH3-11_IGHD3-9*01_IGHJ6*01
caggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagagtattacgatattttgactggttattataacgattactactactactacggtatggacgtctgggggcaagggaccacggtcaccgtctcctcag

SEQ ID NO: 1154 - DNA, 367 bp, Artificial Sequence
  gnl|Fabrus|VH3-11_IGHD4-23*01_IGHJ5*01
caggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagatgactacggtggtaactccgacaactggttcgactcctggggccaaggaaccctggtcaccgtctcctcag

SEQ ID NO: 1155 - DNA, 364 bp, Artificial Sequence
  gnl|Fabrus|VH3-11_IGHD5-18*01_IGHJ4*01
caggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagaggtggatacagctatggttacgactactttgactactggggccaaggaaccctggtcaccgtctcctcag

SEQ ID NO: 1156 - DNA, 382 bp, Artificial Sequence
  gnl|Fabrus|VH3-11_IGHD6-19*01_IGHJ6*01
caggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagaggggtatagcagtggctggtacgattactactactactacggtatggacgtctgggggcaagggaccacggtcaccgtctcctcag

SEQ ID NO: 1157 - DNA, 367 bp, Artificial Sequence
  gnl|Fabrus|VH3-11_IGHD6-6*01_IGHJ1*01
caggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagaggagtatagcagctcgtccgctgaatacttccagcactggggccagggcaccctggtcaccgtctcctcag

SEQ ID NO: 1158 - DNA, 355 bp, Artificial Sequence
  gnl|Fabrus|VH3-11_IGHD7-27*01_IGHJ4*01
caggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagagctaactggggactactttgactactggggccaaggaaccctggtcaccgtctcctcag

SEQ ID NO: 1159 - DNA, 361 bp, Artificial Sequence
  gnl|Fabrus|VH3-13_IGHD1-26*01_IGHJ4*01
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagggtatagtgggagctactacgactactttgactactggggccaaggaaccctggtcaccgtctcctcag

SEQ ID NO: 1160 - DNA, 376 bp, Artificial Sequence
  gnl|Fabrus|VH3-13_IGHD2-8*01_IGHJ5*01
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagaaggatattgtactaatggtgtatgctataccgacaactggttcgactcctggggccaaggaaccctggtcaccgtctcctcag

SEQ ID NO: 1161 - DNA, 376 bp, Artificial Sequence
  gnl|Fabrus|VH3-13_IGHD3-3*01_IGHJ1*01
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagagtattacgatttttggagtggttattataccgctgaatacttccagcactggggccagggcaccctggtcaccgtctcctcag

SEQ ID NO: 1162 - DNA, 388 bp, Artificial Sequence
  gnl|Fabrus|VH3-13_IGHD3-9*01_IGHJ6*01
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagagtattacgatattttgactggttattataacgattactactactactacggtatggacgtctgggggcaagggaccacggtcaccgtctcctcag

SEQ ID NO: 1163 - DNA, 364 bp, Artificial Sequence
  gnl|Fabrus|VH3-13_IGHD4-23*01_IGHJ5*01
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagatgactacggtggtaactccgacaactggttcgactcctggggccaaggaaccctggtcaccgtctcctcag

SEQ ID NO: 1164 - DNA, 361 bp, Artificial Sequence
  gnl|Fabrus|VH3-13_IGHD5-5*01_IGHJ4*01
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagaggtggatacagctatggttacgactactttgactactggggccaaggaaccctggtcaccgtctcctcag

SEQ ID NO: 1165 - DNA, 364 bp, Artificial Sequence
  gnl|Fabrus|VH3-13_IGHD6-6*01_IGHJ1*01
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagaggagtatagcagctcgtccgctgaatacttccagcactggggccagggcaccctggtcaccgtctcctcag

SEQ ID NO: 1166 - DNA, 355 bp, Artificial Sequence
  gnl|Fabrus|VH3-13_IGHD7-27*01_IGHJ5*01
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagctaactggggagacaactggttcgactcctggggccaaggaaccctggtcaccgtctcctcag

SEQ ID NO: 1167 - DNA, 370 bp, Artificial Sequence
  gnl|Fabrus|VH3-15_IGHD1-26*01_IGHJ4*01
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagggtatagtgggagctactacgactactttgactactggggccaaggaaccctggtcaccgtctcctcag

SEQ ID NO: 1168 - DNA, 385 bp, Artificial Sequence
  gnl|Fabrus|VH3-15_IGHD2-15*01_IGHJ2*01
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagaaggatattgtagtggtggtagctgctactcctactggtacttcgatctctggggccgtggcaccctggtcactgtctcctcag

SEQ ID NO: 1169 - DNA, 397 bp, Artificial Sequence
  gnl|Fabrus|VH3-15_IGHD2-15*01_IGHJ6*01
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagaaggatattgtagtggtggtagctgctactccgattactactactactacggtatggacgtctgggggcaagggaccacggtcaccgtctcctcag

SEQ ID NO: 1170 - DNA, 382 bp, Artificial Sequence
  gnl|Fabrus|VH3-15_IGHD3-10*01_IGHJ4*01
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagagtattactatggttcggggagttattataacgactactttgactactggggccaaggaaccctggtcaccgtctcctcag

SEQ ID NO: 1171 - DNA, 385 bp, Artificial Sequence
  gnl|Fabrus|VH3-15_IGHD3-9*01_IGHJ2*01
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagagtattacgatattttgactggttattataactactggtacttcgatctctggggccgtggcaccctggtcactgtctcctcag

SEQ ID NO: 1172 - DNA, 373 bp, Artificial Sequence
  gnl|Fabrus|VH3-15_IGHD5-12*01_IGHJ4*01
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacaggtggatatagtggctacgattacgactactttgactactggggccaaggaaccctggtcaccgtctcctcag

SEQ ID NO: 1173 - DNA, 373 bp, Artificial Sequence
  gnl|Fabrus|VH3-15_IGHD6-6*01_IGHJ1*01
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagaggagtatagcagctcgtccgctgaatacttccagcactggggccagggcaccctggtcaccgtctcctcag

SEQ ID NO: 1174 - DNA, 364 bp, Artificial Sequence
  gnl|Fabrus|VH3-16_IGHD1-1*01_IGHJ1*01
gaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaggtacaactggaacgacgctgaatacttccagcactggggccagggcaccctggtcaccgtctcctcag

SEQ ID NO: 1175 - DNA, 376 bp, Artificial Sequence
  gnl|Fabrus|VH3-16_IGHD1-7*01_IGHJ6*01
gaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaggtataactggaactacgattactactactactacggtatggacgtctgggggcaagggaccacggtcaccgtctcctcag

SEQ ID NO: 1176 - DNA, 379 bp, Artificial Sequence
  gnl|Fabrus|VH3-16_IGHD2-15*01_IGHJ2*01
gaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaaaggatattgtagtggtggtagctgctactcctactggtacttcgatctctggggccgtggcaccctggtcactgtctcctcag

SEQ ID NO: 1177 - DNA, 379 bp, Artificial Sequence
  gnl|Fabrus|VH3-16_IGHD2-2*01_IGHJ2*01
gaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaaaggatattgtagtagtaccagctgctatgcctactggtacttcgatctctggggccgtggcaccctggtcactgtctcctcag

SEQ ID NO: 1178 - DNA, 376 bp, Artificial Sequence
  gnl|Fabrus|VH3-16_IGHD3-10*01_IGHJ4*01
gaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaagtattactatggttcggggagttattataacgactactttgactactggggccaaggaaccctggtcaccgtctcctcag

SEQ ID NO: 1179 - DNA, 364 bp, Artificial Sequence
  gnl|Fabrus|VH3-16_IGHD4-4*01_IGHJ2*01
gaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaatgactacagtaactactactggtacttcgatctctggggccgtggcaccctggtcactgtctcctcag

SEQ ID NO: 1180 - DNA, 364 bp, Artificial Sequence
  gnl|Fabrus|VH3-16_IGHD5-24*01_IGHJ4*01
gaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaagtagagatggctacaattacgactactttgactactggggccaaggaaccctggtcaccgtctcctcag

SEQ ID NO: 1181 - DNA, 367 bp, Artificial Sequence
  gnl|Fabrus|VH3-16_IGHD6-13*01_IGHJ4*01
gaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaaggggtatagcagcagctggtacgactactttgactactggggccaaggaaccctggtcaccgtctcctcag

SEQ ID NO: 1182 - DNA, 358 bp, Artificial Sequence
  gnl|Fabrus|VH3-16_IGHD7-27*01_IGHJ2*01
gaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaactaactggggatactggtacttcgatctctggggccgtggcaccctggtcactgtctcctcag

SEQ ID NO: 1183 - DNA, 361 bp, Artificial Sequence
  gnl|Fabrus|VH3-20_IGHD1-14*01_IGHJ4*01
gaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagggtataaccggaaccacgactactttgactactggggccaaggaaccctggtcaccgtctcctcag

SEQ ID NO: 1184 - DNA, 379 bp, Artificial Sequence
  gnl|Fabrus|VH3-20_IGHD1-14*01_IGHJ4*01
gaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagaaggatattgtagtggtggtagctgctactcctactggtacttcgatctctggggccgtggcaccctggtcactgtctcctcag

SEQ ID NO: 1185 - DNA, 373 bp, Artificial Sequence
  gnl|Fabrus|VH3-20_IGHD2-8*01_IGHJ4*01
gaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagaggatattgtactaatggtgtatgctatacactactttgactactggggccaaggaaccctggtcaccgtctcctcag

SEQ ID NO: 1186 - DNA, 376 bp, Artificial Sequence
  gnl|Fabrus|VH3-20_IGHD3-10*01_IGHJ4*01
gaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagagtattactatggttcggggagttattataacgactactttgactactggggccaaggaaccctggtcaccgtctcctcag

SEQ ID NO: 1187 - DNA, 391 bp, Artificial Sequence
  gnl|Fabrus|VH3-20_IGHD3-9*01_IGHJ6*01
gaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagagtattacgatattttgactggttattataacgattactactactactacggtatggacgtctgggggcaagggaccacggtcaccgtctcctcag

SEQ ID NO: 1188 - DNA, 364 bp, Artificial Sequence
  gnl|Fabrus|VH3-20_IGHD4-23*01_IGHJ4*01
gaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagatgactacggtggtaactccgactactttgactactggggccaaggaaccctggtcaccgtctcctcag

SEQ ID NO: 1189 - DNA, 367 bp, Artificial Sequence
  gnl|Fabrus|VH3-20_IGHD5-12*01_IGHJ4*01
gaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagaggtggatatagtggctacgattacgactactttgactactggggccaaggaaccctggtcaccgtctcctcag

SEQ ID NO: 1190 - DNA, 367 bp, Artificial Sequence
  gnl|Fabrus|VH3-20_IGHD6-13*01_IGHJ4*01
gaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagaggggtatagcagcagctggtacgactactttgactactggggccaaggaaccctggtcaccgtctcctcag

SEQ ID NO: 1191 - DNA, 358 bp, Artificial Sequence
  gnl|Fabrus|VH3-20_IGHD7-27*01_IGHJ2*01
gaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagctaactggggatactggtacttcgatctctggggccgtggcaccctggtcactgtctcctcag

SEQ ID NO: 1192 - DNA, 364 bp, Artificial Sequence
  gnl|Fabrus|VH3-21_IGHD1-26*01_IGHJ4*01
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagggtatagtgggagctactacgactactttgactactggggccaaggaaccctggtcaccgtctcctcag

SEQ ID NO: 1193 - DNA, 379 bp, Artificial Sequence
  gnl|Fabrus|VH3-21_IGHD2-2*01_IGHJ5*01
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagaaggatattgtagtagtaccagctgctatgccgacaactggttcgactcctggggccaaggaaccctggtcaccgtctcctcag

SEQ ID NO: 1194 - DNA, 376 bp, Artificial Sequence
  gnl|Fabrus|VH3-21_IGHD3-22*01_IGHJ4*01
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagagtattactatgatagtagtggttattactacgactactttgactactggggccaaggaaccctggtcaccgtctcctcag

SEQ ID NO: 1195 - DNA, 367 bp, Artificial Sequence
  gnl|Fabrus|VH3-21_IGHD4-23*01_IGHJ5*01
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagatgactacggtggtaactccgacaactggttcgactcctggggccaaggaaccctggtcaccgtctcctcag

SEQ ID NO: 1196 - DNA, 367 bp, Artificial Sequence
  gnl|Fabrus|VH3-21_IGHD5-24*01_IGHJ5*01
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagaggtagagatggctacaattacgacaactggttcgactcctggggccaaggaaccctggtcaccgtctcctcag

SEQ ID NO: 1197 - DNA, 370 bp, Artificial Sequence
  gnl|Fabrus|VH3-21_IGHD6-19*01_IGHJ1*01
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagaggggtatagcagtggctggtacgctgaatacttccagcactggggccagggcaccctggtcaccgtctcctcag

SEQ ID NO: 1198 - DNA, 355 bp, Artificial Sequence
  gnl|Fabrus|VH3-21_IGHD7-27*01_IGHJ4*01
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagctaactggggagactactttgactactggggccaaggaaccctggtcaccgtctcctcag

SEQ ID NO: 1199 - DNA, 364 bp, Artificial Sequence
  gnl|Fabrus|VH3-23_IGHD1-1*01_IGHJ1*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagggtacaactggaacgacgctgaatacttccagcactggggccagggcaccctggtcaccgtctcctcag

SEQ ID NO: 1200 - DNA, 361 bp, Artificial Sequence
  gnl|Fabrus|VH3-23_IGHD1-1*01_IGHJ4*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagggtacaactggaacgaactactttgactactggggccaaggaaccctggtcaccgtctcctcag

SEQ ID NO: 1201 - DNA, 361 bp, Artificial Sequence
  gnl|Fabrus|VH3-23_IGHD1-20*01_IGHJ3*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagggtataactggaacgacgatgcttttgatgtctggggccaagggacaatggtcaccgtctcttcag

SEQ ID NO: 1202 - DNA, 364 bp, Artificial Sequence
  gnl|Fabrus|VH3-23_IGHD1-26*01_IGHJ4*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagggtatagtgggagctactacgactactttgactactggggccaaggaaccctggtcaccgtctcctcag

SEQ ID NO: 1203 - DNA, 376 bp, Artificial Sequence
  gnl|Fabrus|VH3-23_IGHD2-15*01_IGHJ4*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaaggatattgtagtggtggtagctgctactccgactactttgactactggggccaaggaaccctggtcaccgtctcctcag

SEQ ID NO: 1204 - DNA, 376 bp, Artificial Sequence
  gnl|Fabrus|VH3-23_IGHD2-21*01_IGHJ1*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaagcatattgtggtggtgattgctattccgctgaatacttccagcactggggccagggcaccctggtcaccgtctcctcag

SEQ ID NO: 1205 - DNA, 376 bp, Artificial Sequence
  gnl|Fabrus|VH3-23_IGHD3-10*01_IGHJ4*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcag

SEQ ID NO: 1206 - DNA, 382 bp, Artificial Sequence
  gnl|Fabrus|VH3-23_IGHD3-16*01_IGHJ4*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattatgattacgtttgggggagttatgcttataccgactactttgactactggggccaaggaaccctggtcaccgtctcctcag

SEQ ID NO: 1207 - DNA, 376 bp, Artificial Sequence
  gnl|Fabrus|VH3-23_IGHD3-22*01_IGHJ4*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatgatagtagtggttattactacgactactttgactactggggccaaggaaccctggtcaccgtctcctcag

SEQ ID NO: 1208 - DNA, 379 bp, Artificial Sequence
  gnl|Fabrus|VH3-23_IGHD3-3*01_IGHJ5*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattacgatttttggagtggttattataccgacaactggttcgactcctggggccaaggaaccctggtcaccgtctcctcag

SEQ ID NO: 1209 - DNA, 361 bp, Artificial Sequence
  gnl|Fabrus|VH3-23_IGHD4-11*01_IGHJ4*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatgactacagtaactacgactactttgactactggggccaaggaaccctggtcaccgtctcctcag

SEQ ID NO: 1210 - DNA, 367 bp, Artificial Sequence
  gnl|Fabrus|VH3-23_IGHD4-23*01_IGHJ2*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatgactacggtggtaactcctactggtacttcgatctctggggccgtggcaccctggtcactgtctcctcag

SEQ ID NO: 1211 - DNA, 367 bp, Artificial Sequence
  gnl|Fabrus|VH3-23_IGHD5-12*01_IGHJ4*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaggtggatatagtggctacgattacgactactttgactactggggccaaggaaccctggtcaccgtctcctcag

SEQ ID NO: 1212 - DNA, 367 bp, Artificial Sequence
  gnl|Fabrus|VH3-23_IGHD5-24*01_IGHJ1*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaggtagagatggctacaattacgctgaatacttccagcactggggccagggcaccctggtcaccgtctcctcag

SEQ ID NO: 1213 - DNA, 364 bp, Artificial Sequence
  gnl|Fabrus|VH3-23_IGHD5-5*01_IGHJ4*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaggtggatacagctatggttacgactactttgactactggggccaaggaaccctggtcaccgtctcctcag

SEQ ID NO: 1214 - DNA, 367 bp, Artificial Sequence
  gnl|Fabrus|VH3-23_IGHD6-13*01_IGHJ4*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaggggtatagcagcagctggtacgactactttgactactggggccaaggaaccctggtcaccgtctcctcag

SEQ ID NO: 1215 - DNA, 367 bp, Artificial Sequence
  gnl|Fabrus|VH3-23_IGHD6-25*01_IGHJ2*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaggggtatagcagcggctactactggtacttcgatctctggggccgtggcaccctggtcactgtctcctcag

SEQ ID NO: 1216 - DNA, 367 bp, Artificial Sequence
  gnl|Fabrus|VH3-23_IGHD6-6*01_IGHJ1*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaggagtatagcagctcgtccgctgaatacttccagcactggggccagggcaccctggtcaccgtctcctcag

SEQ ID NO: 1217 - DNA, 355 bp, Artificial Sequence
  gnl|Fabrus|VH3-23_IGHD7-27*01_IGHJ4*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagctaactggggagactactttgactactggggccaaggaaccctggtcaccgtctcctcag

SEQ ID NO: 1218 - DNA, 370 bp, Artificial Sequence
  gnl|Fabrus|VH3-23_IGHD7-27*01_IGHJ6*01
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagctaactggggagattactactactactacggtatggacgtctgggggcaagggaccacggtcaccgtctcctcag

SEQ ID NO: 1219 - DNA, 376 bp, Artificial Sequence
  gnl|Fabrus|VH3-30_IGHD1-1*01_IGHJ6*01
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagggtacaactggaacgacgattactactactactacggtatggacgtctgggggcaagggaccacggtcaccgtctcctcag

SEQ ID NO: 1220 - DNA, 367 bp, Artificial Sequence
  gnl|Fabrus|VH3-30_IGHD1-26*01_IGHJ1*01
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagggtatagtgggagctactacgctgaatacttccagcactggggccagggcaccctggtcaccgtctcctcag

SEQ ID NO: 1221 - DNA, 364 bp, Artificial Sequence
  gnl|Fabrus|VH3-30_IGHD1-26*01_IGHJ4*01
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagggtatagtgggagctactacgactactttgactactggggccaaggaaccctggtcaccgtctcctcag

SEQ ID NO: 1222 - DNA, 379 bp, Artificial Sequence
  gnl|Fabrus|VH3-30_IGHD2-15*01_IGHJ2*01
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagaaggatattgtagtggtggtagctgctactcctactggtacttcgatctctggggccgtggcaccctggtcactgtctcctcag

SEQ ID NO: 1223 - DNA, 391 bp, Artificial Sequence
  gnl|Fabrus|VH3-30_IGHD2-2*01_IGHJ6*01
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagaaggatattgtagtagtaccagctgctatgccgattactactactactacggtatggacgtctgggggcaagggaccacggtcaccgtctcctcag

SEQ ID NO: 1224 - DNA, 379 bp, Artificial Sequence
  gnl|Fabrus|VH3-30_IGHD3-10*01_IGHJ1*01
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagaggtattactatggttcggggagttattataacggctgaatacttccagcactggggccagggcaccctggtcaccgtctcctcag

SEQ ID NO: 1225 - DNA, 397 bp, Artificial Sequence
  gnl|Fabrus|VH3-30_IGHD3-16*01_IGHJ6*01
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagagtattatgattacgtttgggggagttatgcttataccgattactactactactacggtatggacgtctgggggcaagggaccacggtcaccgtctcctcag

SEQ ID NO: 1226 - DNA, 361 bp, Artificial Sequence
  gnl|Fabrus|VH3-30_IGHD4-17*01_IGHJ4*01
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagatgactacggtgactacgactactttgactactggggccaaggaaccctggtcaccgtctcctcag

SEQ ID NO: 1227 - DNA, 367 bp, Artificial Sequence
  gnl|Fabrus|VH3-30_IGHD5-12*01_IGHJ4*01
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagaggtggatatagtggctacgattacgactactttgactactggggccaaggaaccctggtcaccgtctcctcag

SEQ ID NO: 1228 - DNA, 367 bp, Artificial Sequence
  gnl|Fabrus|VH3-30_IGHD5-18*01_IGHJ1*01
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagagtggatacagctatggttagctgaatacttccagcactggggccagggcaccctggtcaccgtctcctcag

SEQ ID NO: 1229 - DNA, 367 bp, Artificial Sequence
  gnl|Fabrus|VH3-30_IGHD6-13*01_IGHJ4*01
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagaggggtatagcagcagctggtacgactactttgactactggggccaaggaaccctggtcaccgtctcctcag

SEQ ID NO: 1230 - DNA, 367 bp, Artificial Sequence
  gnl|Fabrus|VH3-30_IGHD6-6*01_IGHJ1*01
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagaggagtatagcagctcgtccgctgaatacttccagcactggggccagggcaccctggtcaccgtctcctcag

SEQ ID NO: 1231 - DNA, 364 bp, Artificial Sequence
  gnl|Fabrus|VH3-35_IGHD1-1*01_IGHJ2*01
gaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaggtacaactggaacgactactggtacttcgatctctggggccgtggcaccctggtcactgtctcctcag

SEQ ID NO: 1232 - DNA, 376 bp, Artificial Sequence
  gnl|Fabrus|VH3-35_IGHD1-1*01_IGHJ2*01
gaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaggtataactggaacgacgattactactactactacggtatggacgtctgggggcaagggaccacggtcaccgtctcctcag

SEQ ID NO: 1233 - DNA, 379 bp, Artificial Sequence
  gnl|Fabrus|VH3-35_IGHD2-15*01_IGHJ2*01
gaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaaaggatattgtagtggtggtagctgctactcctactggtacttcgatctctggggccgtggcaccctggtcactgtctcctcag

SEQ ID NO: 1234 - DNA, 388 bp, Artificial Sequence
  gnl|Fabrus|VH3-35_IGHD2-21*01_IGHJ6*01
gaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaaagcatattgtggtggtgattgctattccgattactactactactacggtatggacgtctgggggcaagggaccacggtcaccgtctcctcag

SEQ ID NO: 1235 - DNA, 376 bp, Artificial Sequence
  gnl|Fabrus|VH3-35_IGHD3-10*01_IGHJ4*01
gaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaagtattactatggttcggggagttattataacgactactttgactactggggccaaggaaccctggtcaccgtctcctcag

SEQ ID NO: 1236 - DNA, 391 bp, Artificial Sequence
  gnl|Fabrus|VH3-35_IGHD3-9*01_IGHJ6*01
gaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaagtattacgatattttgactggttattataacgattactactactactacggtatggacgtctgggggcaagggaccacggtcaccgtctcctcag

SEQ ID NO: 1237 - DNA, 367 bp, Artificial Sequence
  gnl|Fabrus|VH3-35_IGHD5-12*01_IGHJ4*01
gaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaagtggatatagtggctacgattacgactactttgactactggggccaaggaaccctggtcaccgtctcctcag

SEQ ID NO: 1238 - DNA, 367 bp, Artificial Sequence
  gnl|Fabrus|VH3-35_IGHD6-13*01_IGHJ4*01
gaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaaggggtatagcagcagctggtacgactactttgactactggggccaaggaaccctggtcaccgtctcctcag

SEQ ID NO: 1239 - DNA, 358 bp, Artificial Sequence
  gnl|Fabrus|VH3-35_IGHD7-27*01_IGHJ1*01
gaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaactaactggggagctgaatacttccagcactggggccagggcaccctggtcaccgtctcctcag

SEQ ID NO: 1240 - DNA, 358 bp, Artificial Sequence
  gnl|Fabrus|VH3-38_IGHD1-14*01_IGHJ5*01
gaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatggtataaccggaaccacgacaactggttcgactcctggggccaaggaaccctggtcaccgtctcctcag

SEQ ID NO: 1241 - DNA, 370 bp, Artificial Sequence
  gnl|Fabrus|VH3-38_IGHD1-20*01_IGHJ6*01
gaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatggtataactggaacgacgattactactactactacggtatggacgtctgggggcaagggaccacggtcaccgtctcctcag

SEQ ID NO: 1242 - DNA, 385 bp, Artificial Sequence
  gnl|Fabrus|VH3-38_IGHD2-15*01_IGHJ6*01
gaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatggatattgtagtggtggtagctgctactccgattactactactactacggtatggacgtctgggggcaagggaccacggtcaccgtctcctcag

SEQ ID NO: 1243 - DNA, 373 bp, Artificial Sequence
  gnl|Fabrus|VH3-38_IGHD2-2*01_IGHJ1*01
gaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatggatattgtagtagtaccagctgctatgccgctgaatacttccagcactggggccagggcaccctggtcaccgtctcctcag

SEQ ID NO: 1244 - DNA, 370 bp, Artificial Sequence
  gnl|Fabrus|VH3-38_IGHD3-10*01_IGHJ4*01
gaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatattattactatggttcggggagttattataacgactactttgactactggggccaaggaaccctggtcaccgtctcctcag

SEQ ID NO: 1245 - DNA, 379 bp, Artificial Sequence
  gnl|Fabrus|VH3-38_IGHD3-16*01_IGHJ1*01
gaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatattattatgattacgtttgggggagttatgcttataccgctgaatacttccagcactggggccagggcaccctggtcaccgtctcctcag

SEQ ID NO: 1246 - DNA, 358 bp, Artificial Sequence
  gnl|Fabrus|VH3-38_IGHD4-17*01_IGHJ2*01
gaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatgactacggtgactactactggtacttcgatctctggggccgtggcaccctggtcactgtctcctcag

SEQ ID NO: 1247 - DNA, 358 bp, Artificial Sequence
  gnl|Fabrus|VH3-38_IGHD5-24*01_IGHJ3*01
gaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatgtagagatggctacaattacgatgcttttgatgtctggggccaagggacaatggtcaccgtctcttcag

SEQ ID NO: 1248 - DNA, 361 bp, Artificial Sequence
  gnl|Fabrus|VH3-38_IGHD6-6*01_IGHJ1*01
gaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatgagtatagcagctcgtccgctgaatacttccagcactggggccagggcaccctggtcaccgtctcctcag

SEQ ID NO: 1249 - DNA, 364 bp, Artificial Sequence
  gnl|Fabrus|VH3-38_IGHD7-27*01_IGHJ6*01
gaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatctaactggggagattactactactactacggtatggacgtctgggggcaagggaccacggtcaccgtctcctcag

SEQ ID NO: 1250 - DNA, 370 bp, Artificial Sequence
  gnl|Fabrus|VH3-43_IGHD1-26*01_IGHJ5*01
gaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagataggtatagtgggagctactacgacaactggttcgactcctggggccaaggaaccctggtcaccgtctcctcag

SEQ ID NO: 1251 - DNA, 379 bp, Artificial Sequence
  gnl|Fabrus|VH3-43_IGHD1-7*01_IGHJ6*01
gaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagataggtataactggaactacgattactactactactacggtatggacgtctgggggcaagggaccacggtcaccgtctcctcag

SEQ ID NO: 1252 - DNA, 379 bp, Artificial Sequence
  gnl|Fabrus|VH3-43_IGHD2-2*01_IGHJ3*01
gaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatagaggatattgtagtagtaccagctgctatgccgatgcttttgatgtctggggccaagggacaatggtcaccgtctcttcag

SEQ ID NO: 1253 - DNA, 391 bp, Artificial Sequence
  gnl|Fabrus|VH3-43_IGHD2-21*01_IGHJ6*01
gaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatagagcatattgtggtggtgattgctattccgattactactactactacggtatggacgtctgggggcaagggaccacggtcaccgtctcctcag

SEQ ID NO: 1254 - DNA, 400 bp, Artificial Sequence
  gnl|Fabrus|VH3-43_IGHD3-16*01_IGHJ6*01
gaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagataggtattatgattacgtttgggggagttatgcttataccgattactactactactacggtatggacgtctgggggcaagggaccacggtcaccgtctcctcag

SEQ ID NO: 1255 - DNA, 379 bp, Artificial Sequence
  gnl|Fabrus|VH3-43_IGHD3-22*01_IGHJ4*01
gaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagataggtattactatgatagtagtggttattactacgactactttgactactggggccaaggaaccctggtcaccgtctcctcag

SEQ ID NO: 1256 - DNA, 367 bp, Artificial Sequence
  gnl|Fabrus|VH3-43_IGHD4-23*01_IGHJ3*01
gaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatagtgactacggtggtaactccgatgcttttgatgtctggggccaagggacaatggtcaccgtctcttcag

SEQ ID NO: 1257 - DNA, 370 bp, Artificial Sequence
  gnl|Fabrus|VH3-43_IGHD5-18*01_IGHJ5*01
gaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatagtggatacagctatggttacgacaactggttcgactcctggggccaaggaaccctggtcaccgtctcctcag

SEQ ID NO: 1258 - DNA, 367 bp, Artificial Sequence
  gnl|Fabrus|VH3-43_IGHD6-13*01_IGHJ4*01
gaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatgggtatagcagcagctggtacgactactttgactactggggccaaggaaccctggtcaccgtctcctcag

SEQ ID NO: 1259 - DNA, 361 bp, Artificial Sequence
  gnl|Fabrus|VH3-43_IGHD7-27*01_IGHJ1*01
gaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatactaactggggagctgaatacttccagcactggggccagggcaccctggtcaccgtctcctcag

SEQ ID NO: 1260 - DNA, 367 bp, Artificial Sequence
  gnl|Fabrus|VH3-48_IGHD6-6*01_IGHJ1*01
gaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgcgagagaggagtatagcagctcgtccgctgaatacttccagcactggggccagggcaccctggtcaccgtctcctcag

SEQ ID NO: 1261 - DNA, 370 bp, Artificial Sequence
  gnl|Fabrus|VH3-49_IGHD1-26*01_IGHJ4*01
gaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagggtatagtgggagctactacgactactttgactactggggccaaggaaccctggtcaccgtctcctcag

SEQ ID NO: 1262 - DNA, 382 bp, Artificial Sequence
  gnl|Fabrus|VH3-49_IGHD1-7*01_IGHJ6*01
gaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagggtataactggaactacgattactactactactacggtatggacgtctgggggcaagggaccacggtcaccgtctcctcag

SEQ ID NO: 1263 - DNA, 397 bp, Artificial Sequence
  gnl|Fabrus|VH3-49_IGHD2-2*01_IGHJ6*01
gaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagaaggatattgtagtagtaccagctgctatgccgattactactactactacggtatggacgtctgggggcaagggaccacggtcaccgtctcctcag

SEQ ID NO: 1264 - DNA, 382 bp, Artificial Sequence
  gnl|Fabrus|VH3-49_IGHD2-8*01_IGHJ4*01
gaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagaaggatattgtactaatggtgtatgctataccgactactttgactactggggccaaggaaccctggtcaccgtctcctcag

SEQ ID NO: 1265 - DNA, 383 bp, Artificial Sequence
  gnl|Fabrus|VH3-49_IGHD3-22*01_IGHJ4*01
gaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagagtattactatgatagtagtggttattactacgactactttgactactggggccaaggaaccctggtcaccgtctcctcagc

SEQ ID NO: 1266 - DNA, 397 bp, Artificial Sequence
  gnl|Fabrus|VH3-49_IGHD3-9*01_IGHJ6*01
gaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagagtattacgatattttgactggttattataacgattactactactactacggtatggacgtctgggggcaagggaccacggtcaccgtctcctcag

SEQ ID NO: 1267 - DNA, 370 bp, Artificial Sequence
  gnl|Fabrus|VH3-49_IGHD5-18*01_IGHJ4*01
gaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaggtggatacagctatggttacgactactttgactactggggccaaggaaccctggtcaccgtctcctcag

SEQ ID NO: 1268 - DNA, 373 bp, Artificial Sequence
  gnl|Fabrus|VH3-49_IGHD6-13*01_IGHJ4*01
gaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagaggggtatagcagcagctggtacgactactttgactactggggccaaggaaccctggtcaccgtctcctcag

SEQ ID NO: 1269 - DNA, 364 bp, Artificial Sequence
  gnl|Fabrus|VH3-49_IGHD7-27*01_IGHJ1*01
gaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagctaactggggagctgaatacttccagcactggggccagggcaccctggtcaccgtctcctcag

SEQ ID NO: 1270 - DNA, 373 bp, Artificial Sequence
  gnl|Fabrus|VH3-53_IGHD1-14*01_IGHJ6*01
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagggtataaccggaaccacgattactactactactacggtatggacgtctgggggcaagggaccacggtcaccgtctcctcag

SEQ ID NO: 1271 - DNA, 361 bp, Artificial Sequence
  gnl|Fabrus|VH3-53_IGHD1-7*01_IGHJ1*01
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagggtataactggaactacgctgaatacttccagcactggggccagggcaccctggtcaccgtctcctcag

SEQ ID NO: 1272 - DNA, 376 bp, Artificial Sequence
  gnl|Fabrus|VH3-53_IGHD2-2*01_IGHJ2*01
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagaaggatattgtagtagtaccagctgctatgcctactggtacttcgatctctggggccgtggcaccctggtcactgtctcctcag

SEQ ID NO: 1273 - DNA, 373 bp, Artificial Sequence
  gnl|Fabrus|VH3-53_IGHD3-22*01_IGHJ3*01
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagagtattactatgatagtagtggttattactacgatgcttttgatgtctggggccaagggacaatggtcaccgtctcttcag

SEQ ID NO: 1274 - DNA, 364 bp, Artificial Sequence
  gnl|Fabrus|VH3-53_IGHD4-23*01_IGHJ1*01
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagatgactacggtggtaactccgctgaatacttccagcactggggccagggcaccctggtcaccgtctcctcag

SEQ ID NO: 1275 - DNA, 361 bp, Artificial Sequence
  gnl|Fabrus|VH3-53_IGHD5-5*01_IGHJ4*01
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagaggtggatacagctatggttacgactactttgactactggggccaaggaaccctggtcaccgtctcctcag

SEQ ID NO: 1276 - DNA, 364 bp, Artificial Sequence
  gnl|Fabrus|VH3-53_IGHD6-13*01_IGHJ3*01
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagaggggtatagcagcagctggtacgatgcttttgatgtctggggccaagggacaatggtcaccgtctcttcag

SEQ ID NO: 1277 - DNA, 352 bp, Artificial Sequence
  gnl|Fabrus|VH3-53_IGHD7-27*01_IGHJ4*01
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagctaactggggagactactttgactactggggccaaggaaccctggtcaccgtctcctcag

SEQ ID NO: 1278 - DNA, 364 bp, Artificial Sequence
  gnl|Fabrus|VH3-64_IGHD1-26*01_IGHJ4*01
gaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagggtatagtgggagctactacgactactttgactactggggccaaggaaccctggtcaccgtctcctcag

SEQ ID NO: 1279 - DNA, 376 bp, Artificial Sequence
  gnl|Fabrus|VH3-64_IGHD1-7*01_IGHJ6*01
gaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagggtataactggaactacgattactactactactacggtatggacgtctgggggcaagggaccacggtcaccgtctcctcag

SEQ ID NO: 1280 - DNA, 379 bp, Artificial Sequence
  gnl|Fabrus|VH3-64_IGHD2-2*01_IGHJ5*01
gaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagaaggatattgtagtagtaccagctgctatgccgacaactggttcgactcctggggccaaggaaccctggtcaccgtctcctcag

SEQ ID NO: 1281 - DNA, 376 bp, Artificial Sequence
  gnl|Fabrus|VH3-64_IGHD3-3*01_IGHJ4*01
gaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagagtattacgatttttggagtggttattataccgactactttgactactggggccaaggaaccctggtcaccgtctcctcag

SEQ ID NO: 1282 - DNA, 361 bp, Artificial Sequence
  gnl|Fabrus|VH3-64_IGHD4-17*01_IGHJ4*01
gaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagatgactacggtgactacgactactttgactactggggccaaggaaccctggtcaccgtctcctcag

SEQ ID NO: 1283 - DNA, 367 bp, Artificial Sequence
  gnl|Fabrus|VH3-64_IGHD5-12*01_IGHJ4*01
gaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagaggtggatatagtggctacgattacgactactttgactactggggccaaggaaccctggtcaccgtctcctcag

SEQ ID NO: 1284 - DNA, 370 bp, Artificial Sequence
  gnl|Fabrus|VH3-64_IGHD6-19*01_IGHJ1*01
gaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagaggggtatagcagtggctggtacgctgaatacttccagcactggggccagggcaccctggtcaccgtctcctcag

SEQ ID NO: 1285 - DNA, 355 bp, Artificial Sequence
  gnl|Fabrus|VH3-64_IGHD7-27*01_IGHJ4*01
gaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagctaactggggagactactttgactactggggccaaggaaccctggtcaccgtctcctcag

SEQ ID NO: 1286 - DNA, 364 bp, Artificial Sequence
  gnl|Fabrus|VH3-66_IGHD6-6*01_IGHJ1*01
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagctgtggtagcacatactacgcagactccgtgaagggccgattcaccatctccagagacaattccaagaacacgctgtatcttcaaatgaacagcctgagagctgaggacacggctgtgtattactgtgcgagagaggagtatagcagctcgtccgctgaatacttccagcactggggccagggcaccctggtcaccgtctcctcag

SEQ ID NO: 1287 - DNA, 361 bp, Artificial Sequence
  gnl|Fabrus|VH3-7_IGHD1-20*01_IGHJ3*01
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagggtataactggaacgacgatgcttttgatgtctggggccaagggacaatggtcaccgtctcttcag

SEQ ID NO: 1288 - DNA, 376 bp, Artificial Sequence
  gnl|Fabrus|VH3-7_IGHD1-7*01_IGHJ6*01
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagggtataactggaactacgattactactactactacggtatggacgtctgggggcaagggaccacggtcaccgtctcctcag

SEQ ID NO: 1289 - DNA, 376 bp, Artificial Sequence
  gnl|Fabrus|VH3-7_IGHD2-21*01_IGHJ5*01
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaagcatattgtggtggtgattgctattccgacaactggttcgactcctggggccaaggaaccctggtcaccgtctcctcag

SEQ ID NO: 1290 - DNA, 388 bp, Artificial Sequence
  gnl|Fabrus|VH3-7_IGHD2-8*01_IGHJ6*01
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaggatattgtactaatggtgtatgctatacattactactactactacggtatggacgtctgggggcaagggaccacggtcaccgtctcctcag

SEQ ID NO: 1291 - DNA, 376 bp, Artificial Sequence
  gnl|Fabrus|VH3-7_IGHD3-22*01_IGHJ3*01
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagagtattactatgatagtagtggttattactacgatgcttttgatgtctggggccaagggacaatggtcaccgtctcttcag

SEQ ID NO: 1292 - DNA, 391 bp, Artificial Sequence
  gnl|Fabrus|VH3-7_IGHD3-9*01_IGHJ6*01
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagagtattacgatattttgactggttattataacgattactactactactacggtatggacgtctgggggcaagggaccacggtcaccgtctcctcag

SEQ ID NO: 1293 - DNA, 361 bp, Artificial Sequence
  gnl|Fabrus|VH3-7_IGHD4-17*01_IGHJ4*01
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagatgactacggtgactacgactactttgactactggggccaaggaaccctggtcaccgtctcctcag

SEQ ID NO: 1294 - DNA, 367 bp, Artificial Sequence
  gnl|Fabrus|VH3-7_IGHD5-12*01_IGHJ4*01
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagaggtggatatagtggctacgattacgactactttgactactggggccaaggaaccctggtcaccgtctcctcag

SEQ ID NO: 1295 - DNA, 364 bp, Artificial Sequence
  gnl|Fabrus|VH3-7_IGHD5-24*01_IGHJ4*01
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaggtagagatggctacaattaactactttgactactggggccaaggaaccctggtcaccgtctcctcag

SEQ ID NO: 1296 - DNA, 382 bp, Artificial Sequence
  gnl|Fabrus|VH3-7_IGHD6-19*01_IGHJ6*01
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaggggtatagcagtggctggtacgattactactactactacggtatggacgtctgggggcaagggaccacggtcaccgtctcctcag

SEQ ID NO: 1297 - DNA, 367 bp, Artificial Sequence
  gnl|Fabrus|VH3-7_IGHD6-19*01_IGHJ6*01
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaggagtatagcagctcgtccgctgaatacttccagcactggggccagggcaccctggtcaccgtctcctcag

SEQ ID NO: 1298 - DNA, 358 bp, Artificial Sequence
  gnl|Fabrus|VH3-7_IGHD7-27*01_IGHJ2*01
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagctaactggggatactggtacttcgatctctggggccgtggcaccctggtcactgtctcctcag

SEQ ID NO: 1299 - DNA, 367 bp, Artificial Sequence
  gnl|Fabrus|VH3-72_IGHD1-1*01_IGHJ4*01
gaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagggtacaactggaacgacgactactttgactactggggccaaggaaccctggtcaccgtctcctcag

SEQ ID NO: 1300 - DNA, 385 bp, Artificial Sequence
  gnl|Fabrus|VH3-72_IGHD1-1*01_IGHJ4*01
gaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagaaggatattgtagtggtggtagctgctactccgctgaatacttccagcactggggccagggcaccctggtcaccgtctcctcag

SEQ ID NO: 1301 - DNA, 382 bp, Artificial Sequence
  gnl|Fabrus|VH3-72_IGHD3-22*01_IGHJ4*01
gaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagagtattactatgatagtagtggttattactacgactactttgactactggggccaaggaaccctggtcaccgtctcctcag

SEQ ID NO: 1302 - DNA, 397 bp, Artificial Sequence
  gnl|Fabrus|VH3-72_IGHD3-9*01_IGHJ6*01
gaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagagtattacgatattttgactggttattataacgattactactactactacggtatggacgtctgggggcaagggaccacggtcaccgtctcctcag

SEQ ID NO: 1303 - DNA, 373 bp, Artificial Sequence
  gnl|Fabrus|VH3-72_IGHD4-23*01_IGHJ2*01
gaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagatgactacggtggtaactcctactggtacttcgatctctggggccgtggcaccctggtcactgtctcctcag

SEQ ID NO: 1304 - DNA, 370 bp, Artificial Sequence
  gnl|Fabrus|VH3-72_IGHD5-18*01_IGHJ4*01
gaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagaggtggatacagctatggttacgactactttgactactggggccaaggaaccctggtcaccgtctcctcag

SEQ ID NO: 1305 - DNA, 385 bp, Artificial Sequence
  gnl|Fabrus|VH3-72_IGHD5-24*01_IGHJ6*01
gaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagaggtagagatggctacaattacgattactactactactacggtatggacgtctgggggcaagggaccacggtcaccgtctcctcag

SEQ ID NO: 1306 - DNA, 373 bp, Artificial Sequence
  gnl|Fabrus|VH3-72_IGHD6-6*01_IGHJ1*01
gaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagaggagtatagcagctcgtccgctgaatacttccagcactggggccagggcaccctggtcaccgtctcctcag

SEQ ID NO: 1307 - DNA, 364 bp, Artificial Sequence
  gnl|Fabrus|VH3-72_IGHD7-27*01_IGHJ2*01
gaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagctaactggggatactggtacttcgatctctggggccgtggcaccctggtcactgtctcctcag

SEQ ID NO: 1308 - DNA, 370 bp, Artificial Sequence
  gnl|Fabrus|VH3-73_IGHD1-1*01_IGHJ5*01
gaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacggtacaactggaacgacgacaactggttcgactcctggggccaaggaaccctggtcaccgtctcctcag

SEQ ID NO: 1309 - DNA, 385 bp, Artificial Sequence
  gnl|Fabrus|VH3-73_IGHD2-8*01_IGHJ2*01
gaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacaaggatattgtactaatggtgtatgctatacctactggtacttcgatctctggggccgtggcaccctggtcactgtctcctcag

SEQ ID NO: 1310 - DNA, 382 bp, Artificial Sequence
  gnl|Fabrus|VH3-73_IGHD3-22*01_IGHJ4*01
gaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacagtattactatgatagtagtggttattactacgactactttgactactggggccaaggaaccctggtcaccgtctcctcag

SEQ ID NO: 1311 - DNA, 397 bp, Artificial Sequence
  gnl|Fabrus|VH3-73_IGHD3-9*01_IGHJ6*01
gaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacagtattacgatattttgactggttattataacgattactactactactacggtatggacgtctgggggcaagggaccacggtcaccgtctcctcag

SEQ ID NO: 1312 - DNA, 382 bp, Artificial Sequence
  gnl|Fabrus|VH3-73_IGHD4-11*01_IGHJ6*01
gaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacatgactacagtaactacgattactactactactacggtatggacgtctgggggcaagggaccacggtcaccgtctcctcag

SEQ ID NO: 1313 - DNA, 373 bp, Artificial Sequence
  gnl|Fabrus|VH3-73_IGHD4-23*01_IGHJ5*01
gaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacatgactacggtggtaactccgacaactggttcgactcctggggccaaggaaccctggtcaccgtctcctcag

SEQ ID NO: 1314 - DNA, 373 bp, Artificial Sequence
  gnl|Fabrus|VH3-73_IGHD5-12*01_IGHJ4*01
gaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacgtggatatagtggctacgattacgactactttgactactggggccaaggaaccctggtcaccgtctcctcag

SEQ ID NO: 1315 - DNA, 376 bp, Artificial Sequence
  gnl|Fabrus|VH3-73_IGHD6-19*01_IGHJ1*01
gaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacaggggtatagcagtggctggtacgctgaatacttccagcactggggccagggcaccctggtcaccgtctcctcag

SEQ ID NO: 1316 - DNA, 364 bp, Artificial Sequence
  gnl|Fabrus|VH3-73_IGHD7-27*01_IGHJ5*01
gaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacctaactggggagacaactggttcgactcctggggccaaggaaccctggtcaccgtctcctcag

SEQ ID NO: 1317 - DNA, 376 bp, Artificial Sequence
  gnl|Fabrus|VH3-74_IGHD1-1*01_IGHJ6*01
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagggtacaactggaacgacgattactactactactacggtatggacgtctgggggcaagggaccacggtcaccgtctcctcag

SEQ ID NO: 1318 - DNA, 364 bp, Artificial Sequence
  gnl|Fabrus|VH3-74_IGHD1-1*01_IGHJ6*01
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagggtatagtgggagctactacgactactttgactactggggccaaggaaccctggtcaccgtctcctcag

SEQ ID NO: 1319 - DNA, 379 bp, Artificial Sequence
  gnl|Fabrus|VH3-74_IGHD2-2*01_IGHJ5*01
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagaaggatattgtagtagtaccagctgctatgccgacaactggttcgactcctggggccaaggaaccctggtcaccgtctcctcag

SEQ ID NO: 1320 - DNA, 379 bp, Artificial Sequence
  gnl|Fabrus|VH3-74_IGHD3-22*01_IGHJ5*01
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagagtattactatgatagtagtggttattactacgacaactggttcgactcctggggccaaggaaccctggtcaccgtctcctcag

SEQ ID NO: 1321 - DNA, 364 bp, Artificial Sequence
  gnl|Fabrus|VH3-74_IGHD4-17*01_IGHJ1*01
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagatgactacggtgactacgctgaatacttccagcactggggccagggcaccctggtcaccgtctcctcag

SEQ ID NO: 1322 - DNA, 367 bp, Artificial Sequence
  gnl|Fabrus|VH3-74_IGHD5-12*01_IGHJ4*01
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagaggtggatatagtggctacgattacgactactttgactactggggccaaggaaccctggtcaccgtctcctcag

SEQ ID NO: 1323 - DNA, 367 bp, Artificial Sequence
  gnl|Fabrus|VH3-74_IGHD6-6*01_IGHJ1*01
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagaggagtatagcagctcgtccgctgaatacttccagcactggggccagggcaccctggtcaccgtctcctcag

SEQ ID NO: 1324 - DNA, 355 bp, Artificial Sequence
  gnl|Fabrus|VH3-74_IGHD7-27*01_IGHJ4*01
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagctaactggggagactactttgactactggggccaaggaaccctggtcaccgtctcctcag

SEQ ID NO: 1325 - DNA, 379 bp, Artificial Sequence
  gnl|Fabrus|VH3-9_IGHD1-1*01_IGHJ6*01
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagataggtacaactggaacgacgattactactactactacggtatggacgtctgggggcaagggaccacggtcaccgtctcctcag

SEQ ID NO: 1326 - DNA, 367 bp, Artificial Sequence
  gnl|Fabrus|VH3-9_IGHD1-7*01_IGHJ5*01
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagataggtataactggaactacgacaactggttcgactcctggggccaaggaaccctggtcaccgtctcctcag

SEQ ID NO: 1327 - DNA, 379 bp, Artificial Sequence
  gnl|Fabrus|VH3-9_IGHD2-2*01_IGHJ4*01
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatagaggatattgtagtagtaccagctgctatgccgactactttgactactggggccaaggaaccctggtcaccgtctcctcag

SEQ ID NO: 1328 - DNA, 400 bp, Artificial Sequence
  gnl|Fabrus|VH3-9_IGHD3-16*01_IGHJ6*01
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagataggtattatgattacgtttgggggagttatgcttataccgattactactactactacggtatggacgtctgggggcaagggaccacggtcaccgtctcctcag

SEQ ID NO: 1329 - DNA, 379 bp, Artificial Sequence
  gnl|Fabrus|VH3-9_IGHD3-22*01_IGHJ4*01
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagataggtattactatgatagtagtggttattactacgactactttgactactggggccaaggaaccctggtcaccgtctcctcag

SEQ ID NO: 1330 - DNA, 364 bp, Artificial Sequence
  gnl|Fabrus|VH3-9_IGHD4-11*01_IGHJ4*01
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatagtgactacagtaactacgactactttgactactggggccaaggaaccctggtcaccgtctcctcag

SEQ ID NO: 1331 - DNA, 370 bp, Artificial Sequence
  gnl|Fabrus|VH3-9_IGHD5-24*01_IGHJ1*01
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatagtagagatggctacaattacgctgaatacttccagcactggggccagggcaccctggtcaccgtctcctcag

SEQ ID NO: 1332 - DNA, 367 bp, Artificial Sequence
  gnl|Fabrus|VH3-9_IGHD6-13*01_IGHJ4*01
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatgggtatagcagcagctggtacgactactttgactactggggccaaggaaccctggtcaccgtctcctcag

SEQ ID NO: 1333 - DNA, 379 bp, Artificial Sequence
  gnl|Fabrus|VH3-9_IGHD6-25*01_IGHJ6*01
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatgggtatagcagcggctacgattactactactactacggtatggacgtctgggggcaagggaccacggtcaccgtctcctcag

SEQ ID NO: 1334 - DNA, 361 bp, Artificial Sequence
  gnl|Fabrus|VH3-9_IGHD7-27*01_IGHJ2*01
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatactaactggggatactggtacttcgatctctggggccgtggcaccctggtcactgtctcctcag

SEQ ID NO: 1335 - DNA, 364 bp, Artificial Sequence
  gnl|Fabrus|VH4-28_IGHD1-20*01_IGHJ1*01
caggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaggtataactggaacgacgctgaatacttccagcactggggccagggcaccctggtcaccgtctcctcag

SEQ ID NO: 1336 - DNA, 376 bp, Artificial Sequence
  gnl|Fabrus|VH4-28_IGHD1-7*01_IGHJ6*01
caggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaggtataactggaactacgattactactactactacggtatggacgtctgggggcaagggaccacggtcaccgtctcctcag

SEQ ID NO: 1337 - DNA, 391 bp, Artificial Sequence
  gnl|Fabrus|VH4-28_IGHD2-15*01_IGHJ6*01
caggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaaaggatattgtagtggtggtagctgctactccgattactactactactacggtatggacgtctgggggcaagggaccacggtcaccgtctcctcag

SEQ ID NO: 1338 - DNA, 385 bp, Artificial Sequence
  gnl|Fabrus|VH4-28_IGHD3-16*01_IGHJ2*01
caggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaagtattatgattacgtttgggggagttatgcttatacctactggtacttcgatctctggggccgtggcaccctggtcactgtctcctcag

SEQ ID NO: 1339 - DNA, 391 bp, Artificial Sequence
  gnl|Fabrus|VH4-28_IGHD3-16*01_IGHJ2*01
caggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaagtattacgatattttgactggttattataacgattactactactactacggtatggacgtctgggggcaagggaccacggtcaccgtctcctcag

SEQ ID NO: 1340 - DNA, 361 bp, Artificial Sequence
  gnl|Fabrus|VH4-28_IGHD4-4*01_IGHJ4*01
caggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaatgactacagtaactacgactactttgactactggggccaaggaaccctggtcaccgtctcctcag

SEQ ID NO: 1341 - DNA, 367 bp, Artificial Sequence
  gnl|Fabrus|VH4-28_IGHD5-5*01_IGHJ1*01
caggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaagtggatacagctatggttacgctgaatacttccagcactggggccagggcaccctggtcaccgtctcctcag

SEQ ID NO: 1342 - DNA, 367 bp, Artificial Sequence
  gnl|Fabrus|VH4-28_IGHD6-13*01_IGHJ4*01
caggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaaggggtatagcagcagctggtacgactactttgactactggggccaaggaaccctggtcaccgtctcctcag

SEQ ID NO: 1343 - DNA, 358 bp, Artificial Sequence
  gnl|Fabrus|VH4-28_IGHD7-27*01_IGHJ1*01
caggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaactaactggggagctgaatacttccagcactggggccagggcaccctggtcaccgtctcctcag

SEQ ID NO: 1344 - DNA, 370 bp, Artificial Sequence
  gnl|Fabrus|VH4-31_IGHD1-26*01_IGHJ2*01
caggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagggtatagtgggagctactactactggtacttcgatctctggggccgtggcaccctggtcactgtctcctcag

SEQ ID NO: 1345 - DNA, 382 bp, Artificial Sequence
  gnl|Fabrus|VH4-31_IGHD2-15*01_IGHJ2*01
caggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagaaggatattgtagtggtggtagctgctactcctactggtacttcgatctctggggccgtggcaccctggtcactgtctcctcag

SEQ ID NO: 1346 - DNA, 394 bp, Artificial Sequence
  gnl|Fabrus|VH4-31_IGHD2-2*01_IGHJ6*01
caggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagaaggatattgtagtagtaccagctgctatgccgattactactactactacggtatggacgtctgggggcaagggaccacggtcaccgtctcctcag

SEQ ID NO: 1347 - DNA, 379 bp, Artificial Sequence
  gnl|Fabrus|VH4-31_IGHD3-10*01_IGHJ4*01
caggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagagtattactatggttcggggagttattataacgactactttgactactggggccaaggaaccctggtcaccgtctcctcag

SEQ ID NO: 1348 - DNA, 394 bp, Artificial Sequence
  gnl|Fabrus|VH4-31_IGHD3-9*01_IGHJ6*01
caggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagagtattacgatattttgactggttattataacgattactactactactacggtatggacgtctgggggcaagggaccacggtcaccgtctcctcag

SEQ ID NO: 1349 - DNA, 367 bp, Artificial Sequence
  gnl|Fabrus|VH4-31_IGHD4-17*01_IGHJ5*01
caggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatgactacggtgactacgacaactggttcgactcctggggccaaggaaccctggtcaccgtctcctcag

SEQ ID NO: 1350 - DNA, 370 bp, Artificial Sequence
  gnl|Fabrus|VH4-31_IGHD5-12*01_IGHJ4*01
caggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagaggtggatatagtggctacgattacgactactttgactactggggccaaggaaccctggtcaccgtctcctcag

SEQ ID NO: 1351 - DNA, 370 bp, Artificial Sequence
  gnl|Fabrus|VH4-31_IGHD6-13*01_IGHJ4*01
caggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagaggggtatagcagcagctggtacgactactttgactactggggccaaggaaccctggtcaccgtctcctcag

SEQ ID NO: 1352 - DNA, 370 bp, Artificial Sequence
  gnl|Fabrus|VH4-31_IGHD6-6*01_IGHJ1*01
caggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagaggagtatagcagctcgtccgctgaatacttccagcactggggccagggcaccctggtcaccgtctcctcag

SEQ ID NO: 1353 - DNA, 361 bp, Artificial Sequence
  gnl|Fabrus|VH4-31_IGHD7-27*01_IGHJ5*01
caggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagctaactggggagacaactggttcgactcctggggccaaggaaccctggtcaccgtctcctcag

SEQ ID NO: 1354 - DNA, 358 bp, Artificial Sequence
  gnl|Fabrus|VH4-34_IGHD1-7*01_IGHJ4*01
caggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagggtataactggaactacgactactttgactactggggccaaggaaccctggtcaccgtctcctcag

SEQ ID NO: 1355 - DNA, 373 bp, Artificial Sequence
  gnl|Fabrus|VH4-34_IGHD2-2*01_IGHJ4*01
caggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggaggatattgtagtagtaccagctgctatgccgactactttgactactggggccaaggaaccctggtcaccgtctcctcag

SEQ ID NO: 1356 - DNA, 379 bp, Artificial Sequence
  gnl|Fabrus|VH4-34_IGHD3-16*01_IGHJ4*01
caggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagggtattatgattacgtttgggggagttatgcttataccgactactttgactactggggccaaggaaccctggtcaccgtctcctcag

SEQ ID NO: 1357 - DNA, 388 bp, Artificial Sequence
  gnl|Fabrus|VH4-34_IGHD3-22*01_IGHJ6*01
caggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagggtattactatgatagtagtggttattactacgattactactactactacggtatggacgtctgggggcaagggaccacggtcaccgtctcctcag

SEQ ID NO: 1358 - DNA, 358 bp, Artificial Sequence
  gnl|Fabrus|VH4-34_IGHD4-17*01_IGHJ4*01
caggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggtgactacggtgactacgactactttgactactggggccaaggaaccctggtcaccgtctcctcag

SEQ ID NO: 1359 - DNA, 364 bp, Artificial Sequence
  gnl|Fabrus|VH4-34_IGHD5-12*01_IGHJ4*01
caggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggtggatatagtggctacgattacgactactttgactactggggccaaggaaccctggtcaccgtctcctcag

SEQ ID NO: 1360 - DNA, 364 bp, Artificial Sequence
  gnl|Fabrus|VH4-34_IGHD6-13*01_IGHJ4*01
caggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggggggtatagcagcagctggtacgactactttgactactggggccaaggaaccctggtcaccgtctcctcag

SEQ ID NO: 1361 - DNA, 376 bp, Artificial Sequence
  gnl|Fabrus|VH4-34_IGHD6-25*01_IGHJ6*01
caggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggggggtatagcagcggctacgattactactactactacggtatggacgtctgggggcaagggaccacggtcaccgtctcctcag

SEQ ID NO: 1362 - DNA, 376 bp, Artificial Sequence
  gnl|Fabrus|VH4-34_IGHD6-6*01_IGHJ6*01
caggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggggagtatagcagctcgtccgattactactactactacggtatggacgtctgggggcaagggaccacggtcaccgtctcctcag

SEQ ID NO: 1363 - DNA, 352 bp, Artificial Sequence
  gnl|Fabrus|VH4-34_IGHD7-27*01_IGHJ4*01
caggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagctaactggggagactactttgactactggggccaaggaaccctggtcaccgtctcctcag

SEQ ID NO: 1364 - DNA, 367 bp, Artificial Sequence
  gnl|Fabrus|VH4-39_IGHD1-14*01_IGHJ1*01
cagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacggtataaccggaaccacgctgaatacttccagcactggggccagggcaccctggtcaccgtctcctcag

SEQ ID NO: 1365 - DNA, 379 bp, Artificial Sequence
  gnl|Fabrus|VH4-39_IGHD1-20*01_IGHJ6*01
cagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacggtataactggaacgacgattactactactactacggtatggacgtctgggggcaagggaccacggtcaccgtctcctcag

SEQ ID NO: 1366 - DNA, 376 bp, Artificial Sequence
  gnl|Fabrus|VH4-39_IGHD2-21*01_IGHJ3*01
cagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacaagcatattgtggtggtgattgctattccgatgcttttgatgtctggggccaagggacaatggtcaccgtctcttcag

SEQ ID NO: 1367 - DNA, 379 bp, Artificial Sequence
  gnl|Fabrus|VH4-39_IGHD3-10*01_IGHJ4*01
cagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacagtattactatggttcggggagttattataacgactactttgactactggggccaaggaaccctggtcaccgtctcctcag

SEQ ID NO: 1368 - DNA, 388 bp, Artificial Sequence
  gnl|Fabrus|VH4-39_IGHD3-16*01_IGHJ2*01
cagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacagtattatgattacgtttgggggagttatgcttatacctactggtacttcgatctctggggccgtggcaccctggtcactgtctcctcag

SEQ ID NO: 1369 - DNA, 394 bp, Artificial Sequence
  gnl|Fabrus|VH4-39_IGHD3-9*01_IGHJ6*01
cagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacagtattacgatattttgactggttattataacgattactactactactacggtatggacgtctgggggcaagggaccacggtcaccgtctcctcag

SEQ ID NO: 1370 - DNA, 370 bp, Artificial Sequence
  gnl|Fabrus|VH4-39_IGHD4-23*01_IGHJ2*01
cagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacatgactacggtggtaactcctactggtacttcgatctctggggccgtggcaccctggtcactgtctcctcag

SEQ ID NO: 1371 - DNA, 370 bp, Artificial Sequence
  gnl|Fabrus|VH4-39_IGHD5-12*01_IGHJ4*01
cagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacgtggatatagtggctacgattacgactactttgactactggggccaaggaaccctggtcaccgtctcctcag

SEQ ID NO: 1372 - DNA, 370 bp, Artificial Sequence
  gnl|Fabrus|VH4-39_IGHD6-6*01_IGHJ1*01
cagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacaggagtatagcagctcgtccgctgaatacttccagcactggggccagggcaccctggtcaccgtctcctcag

SEQ ID NO: 1373 - DNA, 358 bp, Artificial Sequence
  gnl|Fabrus|VH4-4_IGHD1-20*01_IGHJ3*01
caggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagggtataactggaacgacgatgcttttgatgtctggggccaagggacaatggtcaccgtctcttcag

SEQ ID NO: 1374 - DNA, 373 bp, Artificial Sequence
  gnl|Fabrus|VH4-4_IGHD2-8*01_IGHJ4*01
caggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagaaggatattgtactaatggtgtatgctataccgactactttgactactggggccaaggaaccctggtcaccgtctcctcag

SEQ ID NO: 1375 - DNA, 376 bp, Artificial Sequence
  gnl|Fabrus|VH4-4_IGHD3-22*01_IGHJ2*01
caggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagagtattactatgatagtagtggttattactactactggtacttcgatctctggggccgtggcaccctggtcactgtctcctcag

SEQ ID NO: 1376 - DNA, 361 bp, Artificial Sequence
  gnl|Fabrus|VH4-4_IGHD4-23*01_IGHJ4*01
caggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagatgactacggtggtaactccgactactttgactactggggccaaggaaccctggtcaccgtctcctcag

SEQ ID NO: 1377 - DNA, 367 bp, Artificial Sequence
  gnl|Fabrus|VH4-4_IGHD5-12*01_IGHJ5*01
caggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagaggtggatatagtggctacgattacgacaactggttcgactcctggggccaaggaaccctggtcaccgtctcctcag

SEQ ID NO: 1378 - DNA, 361 bp, Artificial Sequence
  gnl|Fabrus|VH4-4_IGHD6-6*01_IGHJ4*01
caggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagaggagtatagcagctcgtccgactactttgactactggggccaaggaaccctggtcaccgtctcctcag

SEQ ID NO: 1379 - DNA, 367 bp, Artificial Sequence
  gnl|Fabrus|VH4-4_IGHD7-27*01_IGHJ6*01
caggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagctaactggggagattactactactactacggtatggacgtctgggggcaagggaccacggtcaccgtctcctcag

SEQ ID NO: 1380 - DNA, 361 bp, Artificial Sequence
  gnl|Fabrus|VH4-59_IGHD6-25*01_IGHJ3*01
caggtgcagctgcaggagtcgggcccaggactggtgaagccttcggagaccctgtccctcacctgcactgtctctggtggctccatcagtagttactactggagctggattcggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagaggggtatagcagcggctacgatgcttttgatgtctggggccaagggacaatggtcaccgtctcttcag

SEQ ID NO: 1381 - DNA, 361 bp, Artificial Sequence
  gnl|Fabrus|VH5-51_IGHD1-14*01_IGHJ4*01
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacggtataaccggaaccacgactactttgactactggggccaaggaaccctggtcaccgtctcctcag

SEQ ID NO: 1382 - DNA, 379 bp, Artificial Sequence
  gnl|Fabrus|VH5-51_IGHD1-26*01_IGHJ6*01
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacggtatagtgggagctactacgattactactactactacggtatggacgtctgggggcaagggaccacggtcaccgtctcctcag

SEQ ID NO: 1383 - DNA, 376 bp, Artificial Sequence
  gnl|Fabrus|VH5-51_IGHD2-8*01_IGHJ4*01
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacaaggatattgtactaatggtgtatgctataccgactactttgactactggggccaaggaaccctggtcaccgtctcctcag

SEQ ID NO: 1384 - DNA, 391 bp, Artificial Sequence
  gnl|Fabrus|VH5-51_IGHD3-10*01_IGHJ6*01
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacagtattactatggttcggggagttattataacgattactactactactacggtatggacgtctgggggcaagggaccacggtcaccgtctcctcag

SEQ ID NO: 1385 - DNA, 376 bp, Artificial Sequence
  gnl|Fabrus|VH5-51_IGHD3-3*01_IGHJ4*01
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacagtattacgatttttggagtggttattataccgactactttgactactggggccaaggaaccctggtcaccgtctcctcag

SEQ ID NO: 1386 - DNA, 361 bp, Artificial Sequence
  gnl|Fabrus|VH5-51_IGHD4-17*01_IGHJ4*01
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacatgactacggtgactacgactactttgactactggggccaaggaaccctggtcaccgtctcctcag

SEQ ID NO: 1387 - DNA, 364 bp, Artificial Sequence
  gnl|Fabrus|VH5-51_IGHD5-18*01>3_IGHJ4*01
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacgtggatacagctatggttacgactactttgactactggggccaaggaaccctggtcaccgtctcctcag

SEQ ID NO: 1388 - DNA, 364 bp, Artificial Sequence
  gnl|Fabrus|VH5-51_IGHD5-18*01>1_IGHJ4*01
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacaggtggatacagctatggttaactactttgactactggggccaaggaaccctggtcaccgtctcctcag

SEQ ID NO: 1389 - DNA, 364 bp, Artificial Sequence
  gnl|Fabrus|VH5-51_IGHD6-25*01_IGHJ4*01
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacaggggtatagcagcggctacgactactttgactactggggccaaggaaccctggtcaccgtctcctcag

SEQ ID NO: 1390 - DNA, 355 bp, Artificial Sequence
  gnl|Fabrus|VH5-51_IGHD7-27*01_IGHJ4*01
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacagctaactggggactactttgactactggggccaaggaaccctggtcaccgtctcctcag

SEQ ID NO: 1391 - DNA, 370 bp, Artificial Sequence
  gnl|Fabrus|VH6-1_IGHD1-1*01_IGHJ4*01
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagggtacaactggaacgacgactactttgactactggggccaaggaaccctggtcaccgtctcctcag

SEQ ID NO: 1392 - DNA, 385 bp, Artificial Sequence
  gnl|Fabrus|VH6-1_IGHD1-20*01_IGHJ6*01
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagggtataactggaacgacgattactactactactacggtatggacgtctgggggcaagggaccacggtcaccgtctcctcag

SEQ ID NO: 1393 - DNA, 385 bp, Artificial Sequence
  gnl|Fabrus|VH6-1_IGHD2-15*01_IGHJ4*01
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaaggatattgtagtggtggtagctgctactccgactactttgactactggggccaaggaaccctggtcaccgtctcctcag

SEQ ID NO: 1394 - DNA, 397 bp, Artificial Sequence
  gnl|Fabrus|VH6-1_IGHD2-21*01_IGHJ6*01
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaagcatattgtggtggtgattgctattccgattactactactactacggtatggacgtctgggggcaagggaccacggtcaccgtctcctcag

SEQ ID NO: 1395 - DNA, 394 bp, Artificial Sequence
  gnl|Fabrus|VH6-1_IGHD3-16*01_IGHJ5*01
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagagtattatgattacgtttgggggagttatgcttataccgacaactggttcgactcctggggccaaggaaccctggtcaccgtctcctcag

SEQ ID NO: 1396 - DNA, 385 bp, Artificial Sequence
  gnl|Fabrus|VH6-1_IGHD3-3*01_IGHJ4*01
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagagtattacgatttttggagtggttattataccgactactttgactactggggccaaggaaccctggtcaccgtctcctcag

SEQ ID NO: 1397 - DNA, 385 bp, Artificial Sequence
  gnl|Fabrus|VH6-1_IGHD4-11*01_IGHJ6*01
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagatgactacagtaactacgattactactactactacggtatggacgtctgggggcaagggaccacggtcaccgtctcctcag

SEQ ID NO: 1398 - DNA, 373 bp, Artificial Sequence
  gnl|Fabrus|VH6-1_IGHD4-23*01_IGHJ4*01
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagatgactacggtggtaactccgactactttgactactggggccaaggaaccctggtcaccgtctcctcag

SEQ ID NO: 1399 - DNA, 373 bp, Artificial Sequence
  gnl|Fabrus|VH6-1_IGHD5-5*01_IGHJ4*01
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagaggtggatacagctatggttacgactactttgactactggggccaaggaaccctggtcaccgtctcctcag

SEQ ID NO: 1400 - DNA, 376 bp, Artificial Sequence
  gnl|Fabrus|VH6-1_IGHD6-13*01_IGHJ4*01
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaggggtatagcagcagctggtacgactactttgactactggggccaaggaaccctggtcaccgtctcctcag

SEQ ID NO: 1401 - DNA, 388 bp, Artificial Sequence
  gnl|Fabrus|VH6-1_IGHD6-25*01_IGHJ6*01
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaggggtatagcagcggctacgattactactactactacggtatggacgtctgggggcaagggaccacggtcaccgtctcctcag

SEQ ID NO: 1402 - DNA, 364 bp, Artificial Sequence
  gnl|Fabrus|VH6-1_IGHD7-27*01_IGHJ4*01
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagctaactggggagactactttgactactggggccaaggaaccctggtcaccgtctcctcag

SEQ ID NO: 1403 - DNA, 361 bp, Artificial Sequence
  gnl|Fabrus|VH7-81_IGHD1-14*01_IGHJ4*01
caggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatggtataaccggaaccacgactactttgactactggggccaaggaaccctggtcaccgtctcctcag

SEQ ID NO: 1404 - DNA, 376 bp, Artificial Sequence
  gnl|Fabrus|VH7-81_IGHD2-21*01_IGHJ2*01
caggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatatgcatattgtggtggtgattgctattcctactggtacttcgatctctggggccgtggcaccctggtcactgtctcctcag

SEQ ID NO: 1405 - DNA, 388 bp, Artificial Sequence
  gnl|Fabrus|VH7-81_IGHD2-21*01_IGHJ6*01
caggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatatgcatattgtggtggtgattgctattccgattactactactactacggtatggacgtctgggggcaagggaccacggtcaccgtctcctcag

SEQ ID NO: 1406 - DNA, 397 bp, Artificial Sequence
  gnl|Fabrus|VH7-81_IGHD3-16*01_IGHJ6*01
caggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatattattatgattacgtttgggggagttatgcttataccgattactactactactacggtatggacgtctgggggcaagggaccacggtcaccgtctcctcag

SEQ ID NO: 1407 - DNA, 367 bp, Artificial Sequence
  gnl|Fabrus|VH7-81_IGHD4-23*01_IGHJ1*01
caggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatatgactacggtggtaactccgctgaatacttccagcactggggccagggcaccctggtcaccgtctcctcag

SEQ ID NO: 1408 - DNA, 382 bp, Artificial Sequence
  gnl|Fabrus|VH7-81_IGHD5-12*01_IGHJ6*01
caggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatgtggatatagtggctacgattacgattactactactactacggtatggacgtctgggggcaagggaccacggtcaccgtctcctcag

SEQ ID NO: 1409 - DNA, 364 bp, Artificial Sequence
  gnl|Fabrus|VH7-81_IGHD6-25*01_IGHJ4*01
caggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatatgggtatagcagcggctacgactactttgactactggggccaaggaaccctggtcaccgtctcctcag

SEQ ID NO: 1410 - DNA, 355 bp, Artificial Sequence
  gnl|Fabrus|VH7-81_IGHD7-27*01_IGHJ4*01
caggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatctaactggggagactactttgactactggggccaaggaaccctggtcaccgtctcctcag

SEQ ID NO: 1411 - DNA, 325 bp, Artificial Sequence
  gnl|Fabrus|A14_IGKJ1*01
gatgttgtgatgacacagtctccagctttcctctctgtgactccaggggagaaagtcaccatcacctgccaggccagtgaaggcattggcaactacttatactggtaccagcagaaaccagatcaagccccaaagctcctcatcaagtatgcttcccagtccatctcaggggtcccgtcgaggttcagtggcagtggatctgggacagatttcacctttaccatcagtagcctggaagctgaagatgctgcaacatattactgtcagcagggcaataagcaccctcagtggacgttcggccaagggaccaaggtggaaatcaaac

SEQ ID NO: 1412 - DNA, 340 bp, Artificial Sequence
  gnl|Fabrus|A17_IGKJ1*01
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaac

SEQ ID NO: 1413 - DNA, 340 bp, Artificial Sequence
  gnl|Fabrus|A2_IGKJ1*01
gatattgtgatgacccagactccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttcctccgtggacgttcggccaagggaccaaggtggaaatcaaac

SEQ ID NO: 1414 - DNA, 325 bp, Artificial Sequence
  gnl|Fabrus|A20_IGKJ1*01
gacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccctccgtggacgttcggccaagggaccaaggtggaaatcaaac

SEQ ID NO: 1415 - DNA, 340 bp, Artificial Sequence
  gnl|Fabrus|A23_IGKJ1*01
gatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatttcctcagtggacgttcggccaagggaccaaggtggaaatcaaac

SEQ ID NO: 1416 - DNA, 325 bp, Artificial Sequence
  gnl|Fabrus|A26_IGKJ1*01
gaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccttctcaggggtcccgtcgaggttcagtggcagtggatctgggacagatttcaccctcaccatcaatagcctggaagctgaagatgctgcaacgtattactgtcatcagagtagtagtttacctcagtggacgttcggccaagggaccaaggtggaaatcaaac

SEQ ID NO: 1417 - DNA, 328 bp, Artificial Sequence
  gnl|Fabrus|A27_IGKJ1*01
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgtggacgttcggccaagggaccaaggtggaaatcaaac

SEQ ID NO: 1418 - DNA, 328 bp, Artificial Sequence
  gnl|Fabrus|A27_IGKJ3*01
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccattcactttcggccctgggaccaaagtggatatcaaac

SEQ ID NO: 1419 - DNA, 325 bp, Artificial Sequence
  gnl|Fabrus|A30_IGKJ1*01
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaatttactctcacaatcagcagcctgcagcctgaagattttgcaacttattactgtctacagcataatagttaccctccgtggacgttcggccaagggaccaaggtggaaatcaaac

SEQ ID NO: 1420 - DNA, 325 bp, Artificial Sequence
  gnl|Fabrus|B2_IGKJ1*01
gaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccctctgtggacgttcggccaagggaccaaggtggaaatcaaac

SEQ ID NO: 1421 - DNA, 325 bp, Artificial Sequence
  gnl|Fabrus|B2_IGKJ3*01
gaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccctctattcactttcggccctgggaccaaagtggatatcaaac

SEQ ID NO: 1422 - DNA, 343 bp, Artificial Sequence
  gnl|Fabrus|B3_IGKJ1*01
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctccgtggacgttcggccaagggaccaaggtggaaatcaaac

SEQ ID NO: 1423 - DNA, 322 bp, Artificial Sequence
  gnl|Fabrus|HerceptinLC
gacattcagatgacccagagcccgagcagcctgagcgcgagcgtgggcgatcgtgtgaccattacctgccgtgccagccaggatgtgaacaccgcggtggcgtggtatcagcagaaaccgggtaaagccccgaaactgctgatttatagcgccagctttctgtatagcggcgtgccgagccgttttagcggtagccgcagcggcaccgattttaccctgaccattagcagcctgcagccggaagattttgccacctattattgccagcagcattataccaccccgccgacctttggccagggcaccaaagtggaaattaaac

SEQ ID NO: 1424 - DNA, 325 bp, Artificial Sequence
  gnl|Fabrus|L11_IGKJ1*01
gccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattaccctccgtggacgttcggccaagggaccaaggtggaaatcaaac

SEQ ID NO: 1425 - DNA, 325 bp, Artificial Sequence
  gnl|Fabrus|L12_IGKJ1*01
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctatgatgcctccagtttggaaagtggggtcccatcaaggttcagcggcagtggatctgggacagaatttactctcaccatcagcagcctgcagcctgatgattttgcaacttattactgccaacagtataatagttattctccgtggacgttcggccaagggaccaaggtggaaatcaaac

SEQ ID NO: 1426 - DNA, 325 bp, Artificial Sequence
  gnl|Fabrus|L14_IGKJ1*01
aacatccagatgacccagtctccatctgccatgtctgcatctgtaggagacagagtcaccatcacttgtcgggcgaggcagggcattagcaattatttagcctggtttcagcagaaaccagggaaagtccctaagcacctgatctatgctgcatccagtttgcaaagtggggtcccatcaaggttcagcggcagtggatctgggacagaatttactctcacaatcagcagcctgcagcctgaagattttgcaacttattactgtctacagcataatagttaccctccgtggacgttcggccaagggaccaaggtggaaatcaaac

SEQ ID NO: 1427 - DNA, 325 bp, Artificial Sequence
  gnl|Fabrus|L2_IGKJ1*01
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccgtggacgttcggccaagggaccaaggtggaaatcaaac

SEQ ID NO: 1428 - DNA, 325 bp, Artificial Sequence
  gnl|Fabrus|L22_IGKJ3*01
gacatccagatgatccagtctccatctttcctgtctgcatctgtaggagacagagtcagtatcatttgctgggcaagtgagggcattagcagtaatttagcctggtatctgcagaaaccagggaaatcccctaagctcttcctctatgatgcaaaagatttgcaccctggggtctcatcgaggttcagtggcaggggatctgggacggatttcactctcaccatcatcagcctgaagcctgaagattttgcagcttattactgtaaacaggacttcagttaccctccattcactttcggccctgggaccaaagtggatatcaaac

SEQ ID NO: 1429 - DNA, 325 bp, Artificial Sequence
  gnl|Fabrus|L23_IGKJ1*01
gccatccggatgacccagtctccattctccctgtctgcatctgtaggagacagagtcaccatcacttgctgggccagtcagggcattagcagttatttagcctggtatcagcaaaaaccagcaaaagcccctaagctcttcatctattatgcatccagtttgcaaagtggggtcccatcaaggttcagcggcagtggatctgggacggattacactctcaccatcagcagcctgcagcctgaagattttgcaacttattactgtcaacagtattatagtacccctccgtggacgttcggccaagggaccaaggtggaaatcaaac

SEQ ID NO: 1430 - DNA, 328 bp, Artificial Sequence
  gnl|Fabrus|L25_IGKJ1*01
gaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctccgtggacgttcggccaagggaccaaggtggaaatcaaac

SEQ ID NO: 1431 - DNA, 328 bp, Artificial Sequence
  gnl|Fabrus|L25_IGKJ3*01
gaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctccattcactttcggccctgggaccaaagtggatatcaaac

SEQ ID NO: 1432 - DNA, 325 bp, Artificial Sequence
  gnl|Fabrus|L4/18a_IGKJ1*01
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccctcagtggacgttcggccaagggaccaaggtggaaatcaaac

SEQ ID NO: 1433 - DNA, 325 bp, Artificial Sequence
  gnl|Fabrus|L5_IGKJ1*01
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgtggacgttcggccaagggaccaaggtggaaatcaaac

SEQ ID NO: 1434 - DNA, 325 bp, Artificial Sequence
  gnl|Fabrus|L6_IGKJ1*01
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgtggacgttcggccaagggaccaaggtggaaatcaaac

SEQ ID NO: 1435 - DNA, 325 bp, Artificial Sequence
  gnl|Fabrus|L8_IGKJ1*01
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaatttactctcacaatcagcagcctgcagcctgaagattttgcaacttattactgtcaacagcttaatagttaccctccgtggacgttcggccaagggaccaaggtggaaatcaaac

SEQ ID NO: 1436 - DNA, 325 bp, Artificial Sequence
  gnl|Fabrus|L9_IGKJ2*01
gccatccggatgacccagtctccatcctcattctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttaccctctgtatacttttggccaggggaccaagctggagatcaaac

SEQ ID NO: 1437 - DNA, 343 bp, Artificial Sequence
  gnl|Fabrus|O1_IGKJ1*01
gatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttccttcgtggacgttcggccaagggaccaaggtggaaatcaaac

SEQ ID NO: 1438 - DNA, 325 bp, Artificial Sequence
  gnl|Fabrus|O12_IGKJ1*01
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgtggacgttcggccaagggaccaaggtggaaatcaaac

SEQ ID NO: 1439 - DNA, 325 bp, Artificial Sequence
  gnl|Fabrus|O18_IGKJ1*01
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctccgtggacgttcggccaagggaccaaggtggaaatcaaac

SEQ ID NO: 1440 - DNA, 319 bp, Artificial Sequence
  gnl|Fabrus|Anti-CD20 LC
cggatcgtgctgagccagagccccgccatcctgagcgccagccccggcgagaaggtgaccatgacctgcagggccagcagcagcgtgagctacatgcactggtaccagcagaagcccggcagcagccccaagccctggatctacgcccccagcaacctggccagcggcgtgcccgccaggttcagcggcagcggcagcggcaccagctacagcctgaccatcagcagggtggaggccgaggacgccgccacctactactgccagcagtggagcttcaacccccccaccttcggcgccggcaccaagctggagctgaagc

SEQ ID NO: 1441 - DNA, 334 bp, Artificial Sequence
  gnl|Fabrus|V1-11_IGLJ2*01
cagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggtcctgtggtattcggcggagggaccaagctgaccgtcctag

SEQ ID NO: 1442 - DNA, 337 bp, Artificial Sequence
  gnl|Fabrus|V1-13_IGLJ5*01
cagtctgtgctgacgcagccgccctcagtgtctggggccccagggcagagggtcaccatctcctgcactgggagcagctccaacatcggggcaggttatgatgtgcactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttcctgggtgtttggtgaggggaccgagctgaccgtcctag

SEQ ID NO: 1443 - DNA, 334 bp, Artificial Sequence
  gnl|Fabrus|V1-16_IGLJ6*01
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcctaatgtgttcggcagtggcaccaaggtgaccgtcctag

SEQ ID NO: 1444 - DNA, 337 bp, Artificial Sequence
  gnl|Fabrus|V1-18_IGLJ2*01
cagtctgtgctgacgcagccgccctcagtgtctggggccccagggcagagggtcaccatctcctgcactgggagcagctccaacattggggcgggttatgttgtgcattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgaatgctcatgtggtattcggcggagggaccaagctgaccgtcctag

SEQ ID NO: 1445 - DNA, 334 bp, Artificial Sequence
  gnl|Fabrus|V1-2_IGLJ7*01
cagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttcgctgtgttcggaggaggcacccagctgaccgtcctag

SEQ ID NO: 1446 - DNA, 334 bp, Artificial Sequence
  gnl|Fabrus|V1-20_IGLJ6*01
caggcagggctgactcagccaccctcggtgtccaagggcttgagacagaccgccacactcacctgcactgggaacagcaacattgttggcaaccaaggagcagcttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcattggacagcagcctcagtgctcataatgtgttcggcagtggcaccaaggtgaccgtcctag

SEQ ID NO: 1447 - DNA, 334 bp, Artificial Sequence
  gnl|Fabrus|V1-3_IGLJ1*01
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttctatgtcttcggaactgggaccaaggtcaccgtcctag

SEQ ID NO: 1448 - DNA, 334 bp, Artificial Sequence
  gnl|Fabrus|V1-4_IGLJ4*01
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctctttgtatttggtggaggaacccagctgatcatcctag

SEQ ID NO: 1449 - DNA, 334 bp, Artificial Sequence
  gnl|Fabrus|V1-5_IGLJ2*01
cagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagcttatatacaagcagcagcactttcgtggtattcggcggagggaccaagctgaccgtcctag

SEQ ID NO: 1450 - DNA, 334 bp, Artificial Sequence
  gnl|Fabrus|V1-7_IGLJ1*01
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttctatgtcttcggaactgggaccaaggtcaccgtcctag

SEQ ID NO: 1451 - DNA, 334 bp, Artificial Sequence
  gnl|Fabrus|V1-9_IGLJ6*01
caatctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttacactttcaatgtgttcggcagtggcaccaaggtgaccgtcctag

SEQ ID NO: 1452 - DNA, 322 bp, Artificial Sequence
  gnl|Fabrus|V2-1_IGLJ6*01
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcaggcatccctgagcgattctctggctccaactctgggaacacagccactctgaccatcagcgggacccaggctatggatgaggctgactattactgtcaggcgtgggacagcagcactgcaaatgtgttcggcagtggcaccaaggtgaccgtcctag

SEQ ID NO: 1453 - DNA, 328 bp, Artificial Sequence
  gnl|Fabrus|V2-11_IGLJ7*01
tcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcaggcatccctgagcgattctctggctccagctcagggacaatagtcacattgaccatcagtggagtccaggcagaagacgaggctgactattactgtctatcagcagacagcagtggtacttatcctgctgtgttcggaggaggcacccagctgaccgtcctag

SEQ ID NO: 1454 - DNA, 328 bp, Artificial Sequence
  gnl|Fabrus|V2-13_IGLJ2*01
tcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcaggcatcccagaccgattctctggctccagctcaggaaacacagcttccttgaccatcactggggctcaggcggaagatgaggctgactattactgtaactcccgggacagcagtggtaaccatcttgtggtattcggcggagggaccaagctgaccgtcctag

SEQ ID NO: 1455 - DNA, 328 bp, Artificial Sequence
  gnl|Fabrus|V2-14_IGLJ4*01
tcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcaggcatccctgagcgattctctggctccaactctgggaacacggccaccctgaccatcagcagggtcgaagccggggatgaggccgactattactgtcaggtgtgggatagtagtagtgatcatccttttgtatttggtggaggaacccagctgatcatcctag

SEQ ID NO: 1456 - DNA, 322 bp, Artificial Sequence
  gnl|Fabrus|V2-15_IGLJ7*01
tcctatgagctgacacagctaccctcggtgtcagtgtccccaggacagacagccaggatcacctgctctggagatgtactgggggaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctggggatgaggacaatcctgctgtgttcggaggaggcacccagctgaccgtcctag

SEQ ID NO: 1457 - DNA, 328 bp, Artificial Sequence
  gnl|Fabrus|V2-17_IGLJ2*01
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcaggcatccctgagcgattctctggctccagctcagggacaacagtcacgttgaccatcagtggagtccaggcagaagatgaggctgactattactgtcaatcagcagacagcagtggtacttatcctgtggtattcggcggagggaccaagctgaccgtcctag

SEQ ID NO: 1458 - DNA, 322 bp, Artificial Sequence
  gnl|Fabrus|V2-17_IGLJ2*01
tcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcaggcatccctgagcgattctccggctccagctcagggaccacagtcaccttgaccatcagcggggcccaggttgaggatgaggctgactattactgttactctgcggctgacaacaatctttttgtatttggtggaggaacccagctgatcatcctag

SEQ ID NO: 1459 - DNA, 322 bp, Artificial Sequence
  gnl|Fabrus|V2-6_IGLJ4*01
tcctatgagctgactcagccactctcagtgtcagtggccctgggacagacggccaggattacctgtgggggaaacaacattggaagtaaaaatgtgcactggtaccagcagaagccaggccaggcccctgtgctggtcatctatagggatagcaaccggccctctggcatccctgagcgattctctggctccaactcggggaacacggccaccctgaccatcagcagagcccaagccggggatgaggctgactattactgtcaggtgtgggacagcagcactgcatttgtatttggtggaggaacccagctgatcatcctag

SEQ ID NO: 1460 - DNA, 328 bp, Artificial Sequence
  gnl|Fabrus|V2-7_IGLJ2*01
tcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccggcatccctgagagattctctggctccagctcagggacaatggccaccttgactatcagtggggcccaggtggaggatgaagctgactactactgttactcaacagacagcagtggtaatcatagtgtggtattcggcggagggaccaagctgaccgtcctag

SEQ ID NO: 1461 - DNA, 328 bp, Artificial Sequence
  gnl|Fabrus|V2-7_IGLJ7*01
tcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccggcatccctgagagattctctggctccagctcagggacaatggccaccttgactatcagtggggcccaggtggaggatgaagctgactactactgttactcaacagacagcagtggtaatcatagtgctgtgttcggaggaggcacccagctgaccgtcctag

SEQ ID NO: 1462 - DNA, 328 bp, Artificial Sequence
  gnl|Fabrus|V2-8_IGLJ6*01
tcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcaggcatccctgagcgattctctggctccaacccagggaacaccgccaccctaaccatcagcaggatcgaggctggggatgaggctgactattactgtcaggtgtgggacagtagtagtgatcatcctaatgtgttcggcagtggcaccaaggtgaccgtcctag

SEQ ID NO: 1463 - DNA, 331 bp, Artificial Sequence
  gnl|Fabrus|V3-2_IGLJ4*01
cagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgctcagtttgtatttggtggaggaacccagctgatcatcctag

SEQ ID NO: 1464 - DNA, 331 bp, Artificial Sequence
  gnl|Fabrus|V3-3_IGLJ7*01
caggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgctcgggctgtgttcggaggaggcacccagctgaccgtcctag

SEQ ID NO: 1465 - DNA, 334 bp, Artificial Sequence
  gnl|Fabrus|V3-4_IGLJ1*01
cagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttcttatgtcttcggaactgggaccaaggtcaccgtcctag

SEQ ID NO: 1466 - DNA, 349 bp, Artificial Sequence
  gnl|Fabrus|V4-1_IGLJ4*01
cagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggctccaaagatgcttcagccaatacagggattttactcatctccgggctccagtctgaggatgaggctgactattactgtatgatttggccaagcaatgcttcttttgtatttggtggaggaacccagctgatcatcctag

SEQ ID NO: 1467 - DNA, 349 bp, Artificial Sequence
  gnl|Fabrus|V4-2_IGLJ4*01
caggctgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggctccaaagatgcttcggccaatgcagggattttactcatctctgggctccagtctgaggatgaggctgactattactgtatgatttggcacagcagcgcttcttttgtatttggtggaggaacccagctgatcatcctag

SEQ ID NO: 1468 - DNA, 349 bp, Artificial Sequence
  gnl|Fabrus|V4-3_IGLJ4*01
cagcctgtgctgactcagccaacttccctctcagcatctcctggagcatcagccagactcacctgcaccttgcgcagtggcatcaatcttggtagctacaggatattctggtaccagcagaagccagagagccctccccggtatctcctgagctactactcagactcaagtaagcatcagggctctggagtccccagccgcttctctggctccaaagatgcttcgagcaatgcagggattttagtcatctctgggctccagtctgaggatgaggctgactattactgtatgatttggcacagcagtgcttcttttgtatttggtggaggaacccagctgatcatcctag

SEQ ID NO: 1469 - DNA, 355 bp, Artificial Sequence
  gnl|Fabrus|V4-4_IGLJ5*01
cagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggctccaacgatgcatcagccaatgcagggattctgcgtatctctgggctccagcctgaggatgaggctgactattactgtggtacatggcacagcaactctaagactcactgggtgtttggtgaggggaccgagctgaccgtcctag

SEQ ID NO: 1470 - DNA, 349 bp, Artificial Sequence
  gnl|Fabrus|V4-6_IGLJ4*01
cggcccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgctaattttgtatttggtggaggaacccagctgatcatcctag

SEQ ID NO: 1471 - DNA, 337 bp, Artificial Sequence
  gnl|Fabrus|V5-4_IGLJ2*01
cagcctgtgctgactcaatcatcctctgcctctgcttccctgggctcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactcatgtggtattcggcggagggaccaagctgaccgtcctag

SEQ ID NO: 1472 - DNA, 337 bp, Artificial Sequence
  gnl|Fabrus|V5-6_IGLJ1*01
cagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacggcatccctgatcgcttctcaggctccagctctggggctgagcgctacctcaccatctccagcctccagtctgaggatgaggctgactattactgtcagacctggggcactggcattcattatgtcttcggaactgggaccaaggtcaccgtcctag

SEQ ID NO: 1473 - protein, 122 aa, Artificial Sequence
  gnl|Fabrus|HerceptinHC Protein
KVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAS

SEQ ID NO: 1474 - protein, 121 aa, Artificial Sequence
  gnl|Fabrus|Anti-CD20 HC Protein
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVS

SEQ ID NO: 1475 - protein, 122 aa, Artificial Sequence
  gnl|Fabrus|VH1-18_IGHD1-26*01_IGHJ2*01 Protein
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGYSGSYYYWYFDLWGRGTLVTVSS

SEQ ID NO: 1476 - protein, 125 aa, Artificial Sequence
  gnl|Fabrus|VH1-18_IGHD2-21*01_IGHJ2*01 Protein
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAREAYCGGDCYSYWYFDLWGRGTLVTVSS

SEQ ID NO: 1477 - protein, 132 aa, Artificial Sequence
  gnl|Fabrus|VH1-18_IGHD3-16*01_IGHJ6*01 Protein
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAREYYDYVWGSYAYTDYYYYYGMDVWGQGTTVTVSS

SEQ ID NO: 1478 - protein, 125 aa, Artificial Sequence
  gnl|Fabrus|VH1-18_IGHD3-22*01_IGHJ4*01 Protein
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAREYYYDSSGYYYDYFDYWGQGTLVTVSS

SEQ ID NO: 1479 - protein, 122 aa, Artificial Sequence
  gnl|Fabrus|VH1-18_IGHD4-23*01_IGHJ1*01 Protein
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDDYGGNSAEYFQHWGQGTLVTVSS

SEQ ID NO: 1480 - protein, 122 aa, Artificial Sequence
  gnl|Fabrus|VH1-18_IGHD5-12*01_IGHJ4*01 Protein
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGYSGYDYDYFDYWGQGTLVTVSS

SEQ ID NO: 1481 - protein, 122 aa, Artificial Sequence
  gnl|Fabrus|VH1-18_IGHD6-6*01_IGHJ1*01 Protein
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAREEYSSSSAEYFQHWGQGTLVTVSS

SEQ ID NO: 1482 - protein, 120 aa, Artificial Sequence
  gnl|Fabrus|VH1-2_IGHD1-1*01_IGHJ3*01 Protein
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGYNWNDDAFDVWGQGTMVTVSS

SEQ ID NO: 1483 - protein, 120 aa, Artificial Sequence
  gnl|Fabrus|VH1-24_IGHD1-7*01_IGHJ4*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGYNWNYDYFDYWGQGTLVTVSS

SEQ ID NO: 1484 - protein, 126 aa, Artificial Sequence
  gnl|Fabrus|VH1-24_IGHD2-15*01_IGHJ2*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEGYCSGGSCYSYWYFDLWGRGTLVTVSS

SEQ ID NO: 1485 - protein, 125 aa, Artificial Sequence
  gnl|Fabrus|VH1-24_IGHD3-10*01_IGHJ4*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEYYYGSGSYYNDYFDYWGQGTLVTVSS

SEQ ID NO: 1486 - protein, 127 aa, Artificial Sequence
  gnl|Fabrus|VH1-24_IGHD3-16*01_IGHJ4*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEYYDYVWGSYAYTDYFDYWGQGTLVTVSS

SEQ ID NO: 1487 - protein, 122 aa, Artificial Sequence
  gnl|Fabrus|VH1-24_IGHD3-16*01_IGHJ4*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDDYGGNSYWYFDLWGRGTLVTVSS

SEQ ID NO: 1488 - protein, 122 aa, Artificial Sequence
  gnl|Fabrus|VH1-24_IGHD5-12*01_IGHJ4*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGGYSGYDYDYFDYWGQGTLVTVSS

SEQ ID NO: 1489 - protein, 126 aa, Artificial Sequence
  gnl|Fabrus|VH1-24_IGHD5-18*01_IGHJ6*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGGYSYGYDYYYYYGMDVWGQGTTVTVSS

SEQ ID NO: 1490 - protein, 122 aa, Artificial Sequence
  gnl|Fabrus|VH1-24_IGHD6-19*01_IGHJ4*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEGYSSGWYDYFDYWGQGTLVTVSS

SEQ ID NO: 1491 - protein, 126 aa, Artificial Sequence
  gnl|Fabrus|VH1-3_IGHD2-15*01_IGHJ2*01 Protein
QVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCAREGYCSGGSCYSYWYFDLWGRGTLVTVSS

SEQ ID NO: 1492 - protein, 126 aa, Artificial Sequence
  gnl|Fabrus|VH1-3_IGHD2-2*01_IGHJ5*01 Protein
QVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCAREGYCSSTSCYADNWFDSWGQGTLVTVSS

SEQ ID NO: 1493 - protein, 130 aa, Artificial Sequence
  gnl|Fabrus|VH1-3_IGHD3-9*01_IGHJ6*01 Protein
QVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCAREYYDILTGYYNDYYYYYGMDVWGQGTTVTVSS

SEQ ID NO: 1494 - protein, 121 aa, Artificial Sequence
  gnl|Fabrus|VH1-3_IGHD4-23*01_IGHJ4*01 Protein
QVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCARDDYGGNSDYFDYWGQGTLVTVSS

SEQ ID NO: 1495 - protein, 121 aa, Artificial Sequence
  gnl|Fabrus|VH1-3_IGHD5-18*01_IGHJ4*01 Protein
QVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCARGGYSYGYDYFDYWGQGTLVTVSS

SEQ ID NO: 1496 - protein, 122 aa, Artificial Sequence
  gnl|Fabrus|VH1-3_IGHD6-6*01_IGHJ1*01 Protein
QVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCAREEYSSSSAEYFQHWGQGTLVTVSS

SEQ ID NO: 1497 - protein, 118 aa, Artificial Sequence
  gnl|Fabrus|VH1-3_IGHD7-27*01_IGHJ4*01 Protein
QVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCARANWGDYFDYWGQGTLVTVSS

SEQ ID NO: 1498 - protein, 121 aa, Artificial Sequence
  gnl|Fabrus|VH1-45_IGHD1-26*01_IGHJ4*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARWYSGSYYDYFDYWGQGTLVTVSS

SEQ ID NO: 1499 - protein, 130 aa, Artificial Sequence
  gnl|Fabrus|VH1-45_IGHD2-15*01_IGHJ6*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARYGYCSGGSCYSDYYYYYGMDVWGQGTTVTVSS

SEQ ID NO: 1500 - protein, 125 aa, Artificial Sequence
  gnl|Fabrus|VH1-45_IGHD2-8*01_IGHJ3*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARYGYCTNGVCYTDAFDVWGQGTMVTVSS

SEQ ID NO: 1501 - protein, 125 aa, Artificial Sequence
  gnl|Fabrus|VH1-45_IGHD3-10*01_IGHJ4*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARYYYYGSGSYYNDYFDYWGQGTLVTVSS

SEQ ID NO: 1502 - protein, 125 aa, Artificial Sequence
  gnl|Fabrus|VH1-45_IGHD3-16*01_IGHJ2*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARYYYDYVWGSYAYTYWYFDLWGRGTLVT

SEQ ID NO: 1503 - protein, 121 aa, Artificial Sequence
  gnl|Fabrus|VH1-45_IGHD4-23*01_IGHJ4*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARYDYGGNSDYFDYWGQGTLVTVSS

SEQ ID NO: 1504 - protein, 121 aa, Artificial Sequence
  gnl|Fabrus|VH1-45_IGHD5-24*01_IGHJ4*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARCRDGYNYDYFDYWGQGTLVTVSS

SEQ ID NO: 1505 - protein, 122 aa, Artificial Sequence
  gnl|Fabrus|VH1-45_IGHD6-19*01_IGHJ4*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARYGYSSGWYDYFDYWGQGTLVTVSS

SEQ ID NO: 1506 - protein, 123 aa, Artificial Sequence
  gnl|Fabrus|VH1-45_IGHD7-27*01_IGHJ6*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARSNWGDYYYYYGMDVWGQGTTVTVSS

SEQ ID NO: 1507 - protein, 121 aa, Artificial Sequence
  gnl|Fabrus|VH1-46_IGHD1-26*01_IGHJ4*01 Protein
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGYSGSYYDYFDYWGQGTLVTVSS

SEQ ID NO: 1508 - protein, 126 aa, Artificial Sequence
  gnl|Fabrus|VH1-46_IGHD2-15*01_IGHJ2*01 Protein
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREGYCSGGSCYSYWYFDLWGRGTLVTVSS

SEQ ID NO: 1509 - protein, 125 aa, Artificial Sequence
  gnl|Fabrus|VH1-46_IGHD3-10*01_IGHJ4*01 Protein
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREYYYGSGSYYNDYFDYWGQGTLVTVSS

SEQ ID NO: 1510 - protein, 120 aa, Artificial Sequence
  gnl|Fabrus|VH1-46_IGHD4-17*01_IGHJ4*01 Protein
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDDYGDYDYFDYWGQGTLVTVSS

SEQ ID NO: 1511 - protein, 121 aa, Artificial Sequence
  gnl|Fabrus|VH1-46_IGHD5-18*01_IGHJ4*01 Protein
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGGYSYGYDYFDYWGQGTLVTVSS

SEQ ID NO: 1512 - protein, 122 aa, Artificial Sequence
  gnl|Fabrus|VH1-46_IGHD6-13*01_IGHJ4*01 Protein
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREGYSSSWYDYFDYWGQGTLVTVSS

SEQ ID NO: 1513 - protein, 122 aa, Artificial Sequence
  gnl|Fabrus|VH1-46_IGHD6-6*01_IGHJ1*01 Protein
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSSSAEYFQHWGQGTLVTVSS

SEQ ID NO: 1514 - protein, 119 aa, Artificial Sequence
  gnl|Fabrus|VH1-46_IGHD7-27*01_IGHJ2*01 Protein
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARANWGYWYFDLWGRGTLVTVSS

SEQ ID NO: 1515 - protein, 121 aa, Artificial Sequence
  gnl|Fabrus|VH1-58_IGHD1-26*01_IGHJ4*01 Protein
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAGYSGSYYDYFDYWGQGTLVTVSS

SEQ ID NO: 1516 - protein, 126 aa, Artificial Sequence
  gnl|Fabrus|VH1-58_IGHD2-15*01_IGHJ2*01 Protein
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAEGYCSGGSCYSYWYFDLWGRGTLVTVSS

SEQ ID NO: 1517 - protein, 130 aa, Artificial Sequence
  gnl|Fabrus|VH1-58_IGHD3-10*01_IGHJ6*01 Protein
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAEYYYGSGSYYNDYYYYYGMDVWGQGTTVTVSS

SEQ ID NO: 1518 - protein, 120 aa, Artificial Sequence
  gnl|Fabrus|VH1-58_IGHD4-17*01_IGHJ4*01 Protein
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAADDYGDYDYFDYWGQGTLVTVSS

SEQ ID NO: 1519 - protein, 121 aa, Artificial Sequence
  gnl|Fabrus|VH1-58_IGHD4-17*01_IGHJ4*01 Protein
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAGGYSYGYDYFDYWGQGTLVTVSS

SEQ ID NO: 1520 - protein, 122 aa, Artificial Sequence
  gnl|Fabrus|VH1-58_IGHD6-6*01_IGHJ1*01 Protein
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAEEYSSSSAEYFQHWGQGTLVTVSS

SEQ ID NO: 1521 - protein, 119 aa, Artificial Sequence
  gnl|Fabrus|VH1-58_IGHD7-27*01_IGHJ5*01 Protein
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAANWGDNWFDSWGQGTLVTVSS

SEQ ID NO: 1522 - protein, 125 aa, Artificial Sequence
  gnl|Fabrus|VH1-69_IGHD1-1*01_IGHJ6*01  Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGYNWNDDYYYYYGMDVWGQGTTVTVSS

SEQ ID NO: 1523 - protein, 120 aa, Artificial Sequence
  gnl|Fabrus|VH1-69_IGHD1-14*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGYNRNHDYFDYWGQGTLVTVSS

SEQ ID NO: 1524 - protein, 125 aa, Artificial Sequence
  gnl|Fabrus|VH1-69_IGHD2-2*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREGYCSSTSCYADYFDYWGQGTLVTVSS

SEQ ID NO: 1525 - protein, 130 aa, Artificial Sequence
  gnl|Fabrus|VH1-69_IGHD2-8*01_IGHJ6*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREGYCTNGVCYTDYYYYYGMDVWGQGTTVTVSS

SEQ ID NO: 1526 - protein, 127 aa, Artificial Sequence
  gnl|Fabrus|VH1-69_IGHD3-16*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYDYVWGSYAYTDYFDYWGQGTLVTVSS

SEQ ID NO: 1527 - protein, 125 aa, Artificial Sequence
  gnl|Fabrus|VH1-69_IGHD3-3*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYDFWSGYYTDYFDYWGQGTLVTVSS

SEQ ID NO: 1528 - protein, 130 aa, Artificial Sequence
  gnl|Fabrus|VH1-69_IGHD3-9*01_IGHJ6*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYDILTGYYNDYYYYYGMDVWGQGTTVTVSS

SEQ ID NO: 1529 - protein, 120 aa, Artificial Sequence
  gnl|Fabrus|VH1-69_IGHD4-17*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARDDYGDYDYFDYWGQGTLVTVSS

SEQ ID NO: 1530 - protein, 122 aa, Artificial Sequence
  gnl|Fabrus|VH1-69_IGHD5-12*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGGYSGYDYDYFDYWGQGTLVTVSS

SEQ ID NO: 1531 - protein, 126 aa, Artificial Sequence
  gnl|Fabrus|VH1-69_IGHD5-24*01_IGHJ6*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGRDGYNYDYYYYYGMDVWGQGTTVTVSS

SEQ ID NO: 1532 - protein, 122 aa, Artificial Sequence
  gnl|Fabrus|VH1-69_IGHD6-19*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREGYSSGWYDYFDYWGQGTLVTVSS

SEQ ID NO: 1533 - protein, 122 aa, Artificial Sequence
  gnl|Fabrus|VH1-69_IGHD6-6*01_IGHJ1*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREEYSSSSAEYFQHWGQGTLVTVSS

SEQ ID NO: 1534 - protein, 118 aa, Artificial Sequence
  gnl|Fabrus|VH1-69_IGHD7-27*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARELTGDYFDYWGQGTLVTVSS

SEQ ID NO: 1535 - protein, 121 aa, Artificial Sequence
  gnl|Fabrus|VH1-8_IGHD1-26*01_IGHJ4*01 Protein
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGYSGSYYDYFDYWGQGTLVTVSS

SEQ ID NO: 1536 - protein, 130 aa, Artificial Sequence
  gnl|Fabrus|VH1-8_IGHD2-15*01_IGHJ6*01 Protein
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGGYCSGGSCYSDYYYYYGMDVWGQGTTVTVSS

SEQ ID NO: 1537 - protein, 130 aa, Artificial Sequence
  gnl|Fabrus|VH1-8_IGHD2-2*01_IGHJ6*01 Protein
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGGYCSSTSCYADYYYYYGMDVWGQGTTVTVSS

SEQ ID NO: 1538 - protein, 125 aa, Artificial Sequence
  gnl|Fabrus|VH1-8_IGHD3-10*01_IGHJ4*01 Protein
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGYYYGSGSYYNDYFDYWGQGTLVTVSS

SEQ ID NO: 1539 - protein, 120 aa, Artificial Sequence
  gnl|Fabrus|VH1-8_IGHD4-17*01_IGHJ4*01 Protein
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDYGDYDYFDYWGQGTLVTVSS

SEQ ID NO: 1540 - protein, 121 aa, Artificial Sequence
  gnl|Fabrus|VH1-8_IGHD5-5*01_IGHJ4*01 Protein
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGGYSYGYDYFDYWGQGTLVTVSS

SEQ ID NO: 1541 - protein, 118 aa, Artificial Sequence
  gnl|Fabrus|VH1-8_IGHD7-27*01_IGHJ4*01 Protein
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARANWGDYFDYWGQGTLVTVSS

SEQ ID NO: 1542 - protein, 122 aa, Artificial Sequence
  gnl|Fabrus|VH2-26_IGHD1-20*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRYNWNDDYFDYWGQGTLVTVSS

SEQ ID NO: 1543 - protein, 128 aa, Artificial Sequence
  gnl|Fabrus|VH2-26_IGHD2-15*01_IGHJ2*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRGYCSGGSCYSYWYFDLWGRGTLVTVSS

SEQ ID NO: 1544 - protein, 127 aa, Artificial Sequence
  gnl|Fabrus|VH2-26_IGHD2-2*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRGYCSSTSCYADYFDYWGQGTLVTVSS

SEQ ID NO: 1545 - protein, 127 aa, Artificial Sequence
  gnl|Fabrus|VH2-26_IGHD3-10*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRYYYGSGSYYNDYFDYWGQGTLVTVSS

SEQ ID NO: 1546 - protein, 132 aa, Artificial Sequence
  gnl|Fabrus|VH2-26_IGHD3-9*01_IGHJ6*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRYYDILTGYYNDYYYYYGMDVWGQGTTVTVSS

SEQ ID NO: 1547 - protein, 122 aa, Artificial Sequence
  gnl|Fabrus|VH2-26_IGHD3-9*01_IGHJ6*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRDYSNYDYFDYWGQGTLVTVSS

SEQ ID NO: 1548 - protein, 124 aa, Artificial Sequence
  gnl|Fabrus|VH2-26_IGHD5-12*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRGYSGYDYDYFDYWGQGTLVTVSS

SEQ ID NO: 1549 - protein, 123 aa, Artificial Sequence
  gnl|Fabrus|VH2-26_IGHD5-12*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRGYSYGYDYFDYWGQGTLVTVSS

SEQ ID NO: 1550 - protein, 123 aa, Artificial Sequence
  gnl|Fabrus|VH2-26_IGHD6-13*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIGYSSSWYDYFDYWGQGTLVTVSS

SEQ ID NO: 1551 - protein, 119 aa, Artificial Sequence
  gnl|Fabrus|VH2-26_IGHD7-27*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARILTGDYFDYWGQGTLVTVSS

SEQ ID NO: 1552 - protein, 120 aa, Artificial Sequence
  gnl|Fabrus|VH2-26_IGHD7-27*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIPNWGDYFDYWGQGTLVTVSS

SEQ ID NO: 1553 - protein, 123 aa, Artificial Sequence
  gnl|Fabrus|VH2-5_IGHD1-1*01_IGHJ5*01 Protein
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRRYNWNDDNWFDSWGQGTLVTVSS

SEQ ID NO: 1554 - protein, 132 aa, Artificial Sequence
  gnl|Fabrus|VH2-5_IGHD2-15*01_IGHJ6*01 Protein
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRRGYCSGGSCYSDYYYYYGMDVWGQGTTVTVSS

SEQ ID NO: 1555 - protein, 129 aa, Artificial Sequence
  gnl|Fabrus|VH2-5_IGHD3-16*01_IGHJ4*01 Protein
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRRYYDYVWGSYAYTDYFDYWGQGTLVTVSS

SEQ ID NO: 1556 - protein, 132 aa, Artificial Sequence
  gnl|Fabrus|VH2-5_IGHD3-9*01_IGHJ6*01 Protein
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRRYYDILTGYYNDYYYYYGMDVWGQGTTVTVSS

SEQ ID NO: 1557 - protein, 124 aa, Artificial Sequence
  gnl|Fabrus|VH2-5_IGHD5-12*01_IGHJ4*01 Protein
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRRGYSGYDYDYFDYWGQGTLVTVSS

SEQ ID NO: 1558 - protein, 123 aa, Artificial Sequence
  gnl|Fabrus|VH2-5_IGHD6-13*01_IGHJ4*01 Protein
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRGYSSSWYDYFDYWGQGTLVTVSS

SEQ ID NO: 1559 - protein, 121 aa, Artificial Sequence
  gnl|Fabrus|VH2-5_IGHD7-27*01_IGHJ2*01 Protein
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRPNWGYWYFDLWGRGTLVTVSS

SEQ ID NO: 1560 - protein, 123 aa, Artificial Sequence
  gnl|Fabrus|VH2-70_IGHD1-1*01_IGHJ2*01 Protein
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIRYNWNDYWYFDLWGRGTLVTVSS

SEQ ID NO: 1561 - protein, 128 aa, Artificial Sequence
  gnl|Fabrus|VH2-70_IGHD2-15*01_IGHJ2*01 Protein
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIRGYCSGGSCYSYWYFDLWGRGTLVTVSS

SEQ ID NO: 1562 - protein, 127 aa, Artificial Sequence
  gnl|Fabrus|VH2-70_IGHD3-22*01_IGHJ4*01 Protein
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIRYYYDSSGYYYDYFDYWGQGTLVTVSS

SEQ ID NO: 1563 - protein, 132 aa, Artificial Sequence
  gnl|Fabrus|VH2-70_IGHD3-9*01_IGHJ6*01 Protein
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIRYYDILTGYYNDYYYYYGMDVWGQGTTVTVSS

SEQ ID NO: 1564 - protein, 124 aa, Artificial Sequence
  gnl|Fabrus|VH2-70_IGHD5-12*01_IGHJ4*01 Protein
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIRGYSGYDYDYFDYWGQGTLVTVSS

SEQ ID NO: 1565 - protein, 121 aa, Artificial Sequence
  gnl|Fabrus|VH2-70_IGHD7-27*01_IGHJ2*01 Protein
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIPNWGYWYFDLWGRGTLVTVSS

SEQ ID NO: 1566 - protein, 121 aa, Artificial Sequence
  gnl|Fabrus|VH3-11_IGHD1-26*01_IGHJ4*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYSGSYYDYFDYWGQGTLVTVSS

SEQ ID NO: 1567 - protein, 130 aa, Artificial Sequence
  gnl|Fabrus|VH3-11_IGHD2-2*01_IGHJ6*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAREGYCSSTSCYADYYYYYGMDVWGQGTTVTVSS

SEQ ID NO: 1568 - protein, 127 aa, Artificial Sequence
  gnl|Fabrus|VH3-11_IGHD3-16*01_IGHJ4*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAREYYDYVWGSYAYTDYFDYWGQGTLVTVSS

SEQ ID NO: 1569 - protein, 130 aa, Artificial Sequence
  gnl|Fabrus|VH3-11_IGHD3-9*01_IGHJ6*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAREYYDILTGYYNDYYYYYGMDVWGQGTTVTVSS

SEQ ID NO: 1570 - protein, 122 aa, Artificial Sequence
  gnl|Fabrus|VH3-11_IGHD4-23*01_IGHJ5*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDDYGGNSDNWFDSWGQGTLVTVSS

SEQ ID NO: 1571 - protein, 121 aa, Artificial Sequence
  gnl|Fabrus|VH3-11_IGHD5-18*01_IGHJ4*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGGYSYGYDYFDYWGQGTLVTVSS

SEQ ID NO: 1572 - protein, 127 aa, Artificial Sequence
  gnl|Fabrus|VH3-11_IGHD6-19*01_IGHJ6*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAREGYSSGWYDYYYYYGMDVWGQGTTVTVSS

SEQ ID NO: 1573 - protein, 122 aa, Artificial Sequence
  gnl|Fabrus|VH3-11_IGHD6-6*01_IGHJ1*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAREEYSSSSAEYFQHWGQGTLVTVSS

SEQ ID NO: 1574 - protein, 118 aa, Artificial Sequence
  gnl|Fabrus|VH3-11_IGHD7-27*01_IGHJ4*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARELTGDYFDYWGQGTLVTVSS

SEQ ID NO: 1575 - protein, 120 aa, Artificial Sequence
  gnl|Fabrus|VH3-13_IGHD1-26*01_IGHJ4*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARGYSGSYYDYFDYWGQGTLVTVSS

SEQ ID NO: 1576 - protein, 125 aa, Artificial Sequence
  gnl|Fabrus|VH3-13_IGHD2-8*01_IGHJ5*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCAREGYCTNGVCYTDNWFDSWGQGTLVTVSS

SEQ ID NO: 1577 - protein, 125 aa, Artificial Sequence
  gnl|Fabrus|VH3-13_IGHD3-3*01_IGHJ1*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCAREYYDFWSGYYTAEYFQHWGQGTLVTVSS

SEQ ID NO: 1578 - protein, 129 aa, Artificial Sequence
  gnl|Fabrus|VH3-13_IGHD3-9*01_IGHJ6*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCAREYYDILTGYYNDYYYYYGMDVWGQGTTVTVSS

SEQ ID NO: 1579 - protein, 121 aa, Artificial Sequence
  gnl|Fabrus|VH3-13_IGHD4-23*01_IGHJ5*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARDDYGGNSDNWFDSWGQGTLVTVSS

SEQ ID NO: 1580 - protein, 120 aa, Artificial Sequence
  gnl|Fabrus|VH3-13_IGHD5-5*01_IGHJ4*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARGGYSYGYDYFDYWGQGTLVTVSS

SEQ ID NO: 1581 - protein, 121 aa, Artificial Sequence
  gnl|Fabrus|VH3-13_IGHD6-6*01_IGHJ1*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCAREEYSSSSAEYFQHWGQGTLVTVSS

SEQ ID NO: 1582 - protein, 118 aa, Artificial Sequence
  gnl|Fabrus|VH3-13_IGHD7-27*01_IGHJ5*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARANWGDNWFDSWGQGTLVTVSS

SEQ ID NO: 1583 - protein, 123 aa, Artificial Sequence
  gnl|Fabrus|VH3-15_IGHD1-26*01_IGHJ4*01 Protein
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTGYSGSYYDYFDYWGQGTLVTVSS

SEQ ID NO: 1584 - protein, 128 aa, Artificial Sequence
  gnl|Fabrus|VH3-15_IGHD2-15*01_IGHJ2*01 Protein
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTEGYCSGGSCYSYWYFDLWGRGTLVTVSS

SEQ ID NO: 1585 - protein, 132 aa, Artificial Sequence
  gnl|Fabrus|VH3-15_IGHD2-15*01_IGHJ6*01 Protein
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTEGYCSGGSCYSDYYYYYGMDVWGQGTTVTVSS

SEQ ID NO: 1586 - protein, 127 aa, Artificial Sequence
  gnl|Fabrus|VH3-15_IGHD3-10*01_IGHJ4*01 Protein
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTEYYYGSGSYYNDYFDYWGQGTLVTVSS

SEQ ID NO: 1587 - protein, 128 aa, Artificial Sequence
  gnl|Fabrus|VH3-15_IGHD3-9*01_IGHJ2*01 Protein
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTEYYDILTGYYNYWYFDLWGRGTLVTVSS

SEQ ID NO: 1588 - protein, 124 aa, Artificial Sequence
  gnl|Fabrus|VH3-15_IGHD5-12*01_IGHJ4*01 Protein
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTGGYSGYDYDYFDYWGQGTLVTVSS

SEQ ID NO: 1589 - protein, 124 aa, Artificial Sequence
  gnl|Fabrus|VH3-15_IGHD6-6*01_IGHJ1*01 Protein
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTEEYSSSSAEYFQHWGQGTLVTVSS

SEQ ID NO: 1590 - protein, 121 aa, Artificial Sequence
  gnl|Fabrus|VH3-16_IGHD1-1*01_IGHJ1*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRRYNWNDAEYFQHWGQGTLVTVSS

SEQ ID NO: 1591 - protein, 125 aa, Artificial Sequence
  gnl|Fabrus|VH3-16_IGHD1-7*01_IGHJ6*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRRYNWNYDYYYYYGMDVWGQGTTVTVSS

SEQ ID NO: 1592 - protein, 126 aa, Artificial Sequence
  gnl|Fabrus|VH3-16_IGHD2-15*01_IGHJ2*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRKGYCSGGSCYSYWYFDLWGRGTLVTVSS

SEQ ID NO: 1593 - protein, 126 aa, Artificial Sequence
  gnl|Fabrus|VH3-16_IGHD2-2*01_IGHJ2*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRKGYCSSTSCYAYWYFDLWGRGTLVTVSS

SEQ ID NO: 1594 - protein, 125 aa, Artificial Sequence
  gnl|Fabrus|VH3-16_IGHD3-10*01_IGHJ4*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRKYYYGSGSYYNDYFDYWGQGTLVTVSS

SEQ ID NO: 1595 - protein, 121 aa, Artificial Sequence
  gnl|Fabrus|VH3-16_IGHD4-4*01_IGHJ2*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRNDYSNYYWYFDLWGRGTLVTVSS

SEQ ID NO: 1596 - protein, 121 aa, Artificial Sequence
  gnl|Fabrus|VH3-16_IGHD5-24*01_IGHJ4*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRSRDGYNYDYFDYWGQGTLVTVSS

SEQ ID NO: 1597 - protein, 122 aa, Artificial Sequence
  gnl|Fabrus|VH3-16_IGHD6-13*01_IGHJ4*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRKGYSSSWYDYFDYWGQGTLVTVSS

SEQ ID NO: 1598 - protein, 119 aa, Artificial Sequence
  gnl|Fabrus|VH3-16_IGHD7-27*01_IGHJ2*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRTNWGYWYFDLWGRGTLVTVSS

SEQ ID NO: 1599 - protein, 120 aa, Artificial Sequence
  gnl|Fabrus|VH3-20_IGHD1-14*01_IGHJ4*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARGYNRNHDYFDYWGQGTLVTVSS

SEQ ID NO: 1600 - protein, 126 aa, Artificial Sequence
  gnl|Fabrus|VH3-20_IGHD2-15*01_IGHJ2*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCAREGYCSGGSCYSYWYFDLWGRGTLVTVSS

SEQ ID NO: 1601 - protein, 124 aa, Artificial Sequence
  gnl|Fabrus|VH3-20_IGHD2-8*01_IGHJ4*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCAREDIVLMVYAIHYFDYWGQGTLVTVSS

SEQ ID NO: 1602 - protein, 125 aa, Artificial Sequence
  gnl|Fabrus|VH3-20_IGHD3-10*01_IGHJ4*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCAREYYYGSGSYYNDYFDYWGQGTLVTVSS

SEQ ID NO: 1603 - protein, 130 aa, Artificial Sequence
  gnl|Fabrus|VH3-20_IGHD3-9*01_IGHJ6*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCAREYYDILTGYYNDYYYYYGMDVWGQGTTVTVSS

SEQ ID NO: 1604 - protein, 121 aa, Artificial Sequence
  gnl|Fabrus|VH3-20_IGHD4-23*01_IGHJ4*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARDDYGGNSDYFDYWGQGTLVTVSS

SEQ ID NO: 1605 - protein, 122 aa, Artificial Sequence
  gnl|Fabrus|VH3-20_IGHD5-12*01_IGHJ4*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARGGYSGYDYDYFDYWGQGTLVTVSS

SEQ ID NO: 1606 - protein, 122 aa, Artificial Sequence
  gnl|Fabrus|VH3-20_IGHD6-13*01_IGHJ4*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCAREGYSSSWYDYFDYWGQGTLVTVSS

SEQ ID NO: 1607 - protein, 119 aa, Artificial Sequence
  gnl|Fabrus|VH3-20_IGHD7-27*01_IGHJ2*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARANWGYWYFDLWGRGTLVTVSS

SEQ ID NO: 1608 - protein, 121 aa, Artificial Sequence
  gnl|Fabrus|VH3-21_IGHD1-26*01_IGHJ4*01 Protein
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGYSGSYYDYFDYWGQGTLVTVSS

SEQ ID NO: 1609 - protein, 126 aa, Artificial Sequence
  gnl|Fabrus|VH3-21_IGHD2-2*01_IGHJ5*01 Protein
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREGYCSSTSCYADNWFDSWGQGTLVTVSS

SEQ ID NO: 1610 - protein, 125 aa, Artificial Sequence
  gnl|Fabrus|VH3-21_IGHD3-22*01_IGHJ4*01 Protein
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREYYYDSSGYYYDYFDYWGQGTLVTVSS

SEQ ID NO: 1611 - protein, 122 aa, Artificial Sequence
  gnl|Fabrus|VH3-21_IGHD4-23*01_IGHJ5*01 Protein
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDDYGGNSDNWFDSWGQGTLVTVSS

SEQ ID NO: 1612 - protein, 122 aa, Artificial Sequence
  gnl|Fabrus|VH3-21_IGHD5-24*01_IGHJ5*01 Protein
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGRDGYNYDNWFDSWGQGTLVTVSS

SEQ ID NO: 1613 - protein, 123 aa, Artificial Sequence
  gnl|Fabrus|VH3-21_IGHD6-19*01_IGHJ1*01 Protein
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREGYSSGWYAEYFQHWGQGTLVTVSS

SEQ ID NO: 1614 - protein, 118 aa, Artificial Sequence
  gnl|Fabrus|VH3-21_IGHD7-27*01_IGHJ4*01 Protein
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARANWGDYFDYWGQGTLVTVSS

SEQ ID NO: 1615 - protein, 121 aa, Artificial Sequence
  gnl|Fabrus|VH3-23_IGHD1-1*01_IGHJ1*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGYNWNDAEYFQHWGQGTLVTVSS

SEQ ID NO: 1616 - protein, 120 aa, Artificial Sequence
  gnl|Fabrus|VH3-23_IGHD1-1*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEGTTGTNYFDYWGQGTLVTVSS

SEQ ID NO: 1617 - protein, 120 aa, Artificial Sequence
  gnl|Fabrus|VH3-23_IGHD1-20*01_IGHJ3*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGYNWNDDAFDVWGQGTMVTVSS

SEQ ID NO: 1618 - protein, 121 aa, Artificial Sequence
  gnl|Fabrus|VH3-23_IGHD1-26*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGYSGSYYDYFDYWGQGTLVTVSS

SEQ ID NO: 1619 - protein, 125 aa, Artificial Sequence
  gnl|Fabrus|VH3-23_IGHD2-15*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEGYCSGGSCYSDYFDYWGQGTLVTVSS

SEQ ID NO: 1620 - protein, 125 aa, Artificial Sequence
  gnl|Fabrus|VH3-23_IGHD2-21*01_IGHJ1*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEAYCGGDCYSAEYFQHWGQGTLVTVSS

SEQ ID NO: 1621 - protein, 125 aa, Artificial Sequence
  gnl|Fabrus|VH3-23_IGHD3-10*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEYYYGSGSYYNDYFDYWGQGTLVTVSS

SEQ ID NO: 1622 - protein, 127 aa, Artificial Sequence
  gnl|Fabrus|VH3-23_IGHD3-16*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEYYDYVWGSYAYTDYFDYWGQGTLVTVSS

SEQ ID NO: 1623 - protein, 125 aa, Artificial Sequence
  gnl|Fabrus|VH3-23_IGHD3-22*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEYYYDSSGYYYDYFDYWGQGTLVTVSS

SEQ ID NO: 1624 - protein, 126 aa, Artificial Sequence
  gnl|Fabrus|VH3-23_IGHD3-3*01_IGHJ5*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEYYDFWSGYYTDNWFDSWGQGTLVTVSS

SEQ ID NO: 1625 - protein, 120 aa, Artificial Sequence
  gnl|Fabrus|VH3-23_IGHD4-11*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDDYSNYDYFDYWGQGTLVTVSS

SEQ ID NO: 1626 - protein, 122 aa, Artificial Sequence
  gnl|Fabrus|VH3-23_IGHD4-23*01_IGHJ2*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDDYGGNSYWYFDLWGRGTLVTVSS

SEQ ID NO: 1627 - protein, 122 aa, Artificial Sequence
  gnl|Fabrus|VH3-23_IGHD5-12*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGGYSGYDYDYFDYWGQGTLVTVSS

SEQ ID NO: 1628 - protein, 122 aa, Artificial Sequence
  gnl|Fabrus|VH3-23_IGHD5-24*01_IGHJ1*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGRDGYNYAEYFQHWGQGTLVTVSS

SEQ ID NO: 1629 - protein, 121 aa, Artificial Sequence
  gnl|Fabrus|VH3-23_IGHD5-24*01_IGHJ1*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGGYSYGYDYFDYWGQGTLVTVSS

SEQ ID NO: 1630 - protein, 122 aa, Artificial Sequence
  gnl|Fabrus|VH3-23_IGHD6-13*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEGYSSSWYDYFDYWGQGTLVTVSS

SEQ ID NO: 1631 - protein, 122 aa, Artificial Sequence
  gnl|Fabrus|VH3-23_IGHD6-25*01_IGHJ2*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEGYSSGYYWYFDLWGRGTLVTVSS

SEQ ID NO: 1632 - protein, 122 aa, Artificial Sequence
  gnl|Fabrus|VH3-23_IGHD6-6*01_IGHJ1*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEEYSSSSAEYFQHWGQGTLVTVSS

SEQ ID NO: 1633 - protein, 118 aa, Artificial Sequence
  gnl|Fabrus|VH3-23_IGHD7-27*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKANWGDYFDYWGQGTLVTVSS

SEQ ID NO: 1634 - protein, 123 aa, Artificial Sequence
  gnl|Fabrus|VH3-23_IGHD7-27*01_IGHJ6*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKANWGDYYYYYGMDVWGQGTTVTVSS

SEQ ID NO: 1635 - protein, 125 aa, Artificial Sequence
  gnl|Fabrus|VH3-30_IGHD1-1*01_IGHJ6*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGYNWNDDYYYYYGMDVWGQGTTVTVSS

SEQ ID NO: 1636 - protein, 122 aa, Artificial Sequence
  gnl|Fabrus|VH3-30_IGHD1-26*01_IGHJ1*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGYSGSYYAEYFQHWGQGTLVTVSS

SEQ ID NO: 1637 - protein, 121 aa, Artificial Sequence
  gnl|Fabrus|VH3-30_IGHD1-26*01_IGHJ4*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGYSGSYYDYFDYWGQGTLVTVSS

SEQ ID NO: 1638 - protein, 126 aa, Artificial Sequence
  gnl|Fabrus|VH3-30_IGHD2-15*01_IGHJ2*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAREGYCSGGSCYSYWYFDLWGRGTLVTVSS

SEQ ID NO: 1639 - protein, 130 aa, Artificial Sequence
  gnl|Fabrus|VH3-30_IGHD2-2*01_IGHJ6*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAREGYCSSTSCYADYYYYYGMDVWGQGTTVTVSS

SEQ ID NO: 1640 - protein, 126 aa, Artificial Sequence
  gnl|Fabrus|VH3-30_IGHD3-10*01_IGHJ1*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGITMVRGVIITAEYFQHWGQGTLVTVSS

SEQ ID NO: 1641 - protein, 132 aa, Artificial Sequence
  gnl|Fabrus|VH3-30_IGHD3-16*01_IGHJ6*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAREYYDYVWGSYAYTDYYYYYGMDVWGQGTTVTVSS

SEQ ID NO: 1642 - protein, 120 aa, Artificial Sequence
  gnl|Fabrus|VH3-30_IGHD4-17*01_IGHJ4*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDDYGDYDYFDYWGQGTLVTVSS

SEQ ID NO: 1643 - protein, 122 aa, Artificial Sequence
  gnl|Fabrus|VH3-30_IGHD5-12*01_IGHJ4*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGGYSGYDYDYFDYWGQGTLVTVSS

SEQ ID NO: 1644 - protein, 122 aa, Artificial Sequence
  gnl|Fabrus|VH3-30_IGHD5-18*01_IGHJ1*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAREWIQLWLAEYFQHWGQGTLVTVSS

SEQ ID NO: 1645 - protein, 122 aa, Artificial Sequence
  gnl|Fabrus|VH3-30_IGHD6-13*01_IGHJ4*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAREGYSSSWYDYFDYWGQGTLVTVSS

SEQ ID NO: 1646 - protein, 122 aa, Artificial Sequence
  gnl|Fabrus|VH3-30_IGHD6-6*01_IGHJ1*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAREEYSSSSAEYFQHWGQGTLVTVSS

SEQ ID NO: 1647 - protein, 121 aa, Artificial Sequence
  gnl|Fabrus|VH3-30_IGHD6-6*01_IGHJ1*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRRYNWNDYWYFDLWGRGTLVTVSS

SEQ ID NO: 1648 - protein, 125 aa, Artificial Sequence
  gnl|Fabrus|VH3-35_IGHD1-20*01_IGHJ6*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRRYNWNDDYYYYYGMDVWGQGTTVTVSS

SEQ ID NO: 1649 - protein, 126 aa, Artificial Sequence
  gnl|Fabrus|VH3-35_IGHD2-15*01_IGHJ2*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRKGYCSGGSCYSYWYFDLWGRGTLVTVSS

SEQ ID NO: 1650 - protein, 129 aa, Artificial Sequence
  gnl|Fabrus|VH3-35_IGHD2-21*01_IGHJ6*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRKAYCGGDCYSDYYYYYGMDVWGQGTTVTVSS

SEQ ID NO: 1651 - protein, 125 aa, Artificial Sequence
  gnl|Fabrus|VH3-35_IGHD3-10*01_IGHJ4*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRKYYYGSGSYYNDYFDYWGQGTLVTVSS

SEQ ID NO: 1652 - protein, 130 aa, Artificial Sequence
  gnl|Fabrus|VH3-35_IGHD3-9*01_IGHJ6*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRKYYDILTGYYNDYYYYYGMDVWGQGTTVTVSS

SEQ ID NO: 1653 - protein, 122 aa, Artificial Sequence
  gnl|Fabrus|VH3-35_IGHD5-12*01_IGHJ4*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRSGYSGYDYDYFDYWGQGTLVTVSS

SEQ ID NO: 1654 - protein, 122 aa, Artificial Sequence
  gnl|Fabrus|VH3-35_IGHD6-13*01_IGHJ4*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRKGYSSSWYDYFDYWGQGTLVTVSS

SEQ ID NO: 1655 - protein, 119 aa, Artificial Sequence
  gnl|Fabrus|VH3-35_IGHD7-27*01_IGHJ1*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRTNWGAEYFQHWGQGTLVTVSS

SEQ ID NO: 1656 - protein, 119 aa, Artificial Sequence
  gnl|Fabrus|VH3-38_IGHD1-14*01_IGHJ5*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARWYNRNHDNWFDSWGQGTLVTVSS

SEQ ID NO: 1657 - protein, 123 aa, Artificial Sequence
  gnl|Fabrus|VH3-38_IGHD1-20*01_IGHJ6*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARWYNWNDDYYYYYGMDVWGQGTTVTVSS

SEQ ID NO: 1658 - protein, 128 aa, Artificial Sequence
  gnl|Fabrus|VH3-38_IGHD2-15*01_IGHJ6*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARYGYCSGGSCYSDYYYYYGMDVWGQGTTVTVSS

SEQ ID NO: 1659 - protein, 124 aa, Artificial Sequence [sequence omitted]

SEQ ID NO: 1660 - protein, 123 aa, Artificial Sequence
  gnl|Fabrus|VH3-38_IGHD3-10*01_IGHJ4*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARYYYYGSGSYYNDYFDYWGQGTLVTVSS

SEQ ID NO: 1661 - protein, 126 aa, Artificial Sequence
  gnl|Fabrus|VH3-38_IGHD3-16*01_IGHJ1*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARYYYDYVWGSYAYTAEYFQHWGQGTLVTVSS

SEQ ID NO: 1662 - protein, 119 aa, Artificial Sequence
  gnl|Fabrus|VH3-38_IGHD4-17*01_IGHJ2*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARYDYGDYYWYFDLWGRGTLVTVSS

SEQ ID NO: 1663 - protein, 119 aa, Artificial Sequence
  gnl|Fabrus|VH3-38_IGHD5-24*01_IGHJ3*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARCRDGYNYDAFDVWGQGTMVTVSS

SEQ ID NO: 1664 - protein, 120 aa, Artificial Sequence
  gnl|Fabrus|VH3-38_IGHD5-24*01_IGHJ3*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARYEYSSSSAEYFQHWGQGTLVTVSS

SEQ ID NO: 1665 - protein, 121 aa, Artificial Sequence
  gnl|Fabrus|VH3-38_IGHD7-27*01_IGHJ6*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARSNWGDYYYYYGMDVWGQGTTVTVSS

SEQ ID NO: 1666 - protein, 123 aa, Artificial Sequence
  gnl|Fabrus|VH3-43_IGHD1-26*01_IGHJ5*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDRYSGSYYDNWFDSWGQGTLVTVSS

SEQ ID NO: 1667 - protein, 126 aa, Artificial Sequence
  gnl|Fabrus|VH3-43_IGHD1-7*01_IGHJ6*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDRYNWNYDYYYYYGMDVWGQGTTVTVSS

SEQ ID NO: 1668 - protein, 126 aa, Artificial Sequence
  gnl|Fabrus|VH3-43_IGHD2-2*01_IGHJ3*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDRGYCSSTSCYADAFDVWGQGTMVTVSS

SEQ ID NO: 1669 - protein, 130 aa, Artificial Sequence
  gnl|Fabrus|VH3-43_IGHD2-21*01_IGHJ6*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDRAYCGGDCYSDYYYYYGMDVWGQGTTVTVSS

SEQ ID NO: 1670 - protein, 133 aa, Artificial Sequence
  gnl|Fabrus|VH3-43_IGHD3-16*01_IGHJ6*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDRYYDYVWGSYAYTDYYYYYGMDVWGQGTTVTVSS

SEQ ID NO: 1671 - protein, 126 aa, Artificial Sequence
  gnl|Fabrus|VH3-43_IGHD3-22*01_IGHJ4*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDRYYYDSSGYYYDYFDYWGQGTLVTVSS

SEQ ID NO: 1672 - protein, 122 aa, Artificial Sequence
  gnl|Fabrus|VH3-43_IGHD4-23*01_IGHJ3*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDSDYGGNSDAFDVWGQGTMVTVSS

SEQ ID NO: 1673 - protein, 123 aa, Artificial Sequence
  gnl|Fabrus|VH3-43_IGHD5-18*01_IGHJ5*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDSGYSYGYDNWFDSWGQGTLVTVSS

SEQ ID NO: 1674 - protein, 122 aa, Artificial Sequence
  gnl|Fabrus|VH3-43_IGHD6-13*01_IGHJ4*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDGYSSSWYDYFDYWGQGTLVTVSS

SEQ ID NO: 1675 - protein, 120 aa, Artificial Sequence
  gnl|Fabrus|VH3-43_IGHD7-27*01_IGHJ1*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDTNWGAEYFQHWGQGTLVTVSS

SEQ ID NO: 1676 - protein, 122 aa, Artificial Sequence
  gnl|Fabrus|VH3-48_IGHD6-6*01_IGHJ1*01 Protein
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCAREEYSSSSAEYFQHWGQGTLVTVSS

SEQ ID NO: 1677 - protein, 123 aa, Artificial Sequence
  gnl|Fabrus|VH3-49_IGHD1-26*01_IGHJ4*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRGYSGSYYDYFDYWGQGTLVTVSS

SEQ ID NO: 1678 - protein, 127 aa, Artificial Sequence
  gnl|Fabrus|VH3-49_IGHD1-7*01_IGHJ6*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRGYNWNYDYYYYYGMDVWGQGTTVTVSS

SEQ ID NO: 1679 - protein, 132 aa, Artificial Sequence
  gnl|Fabrus|VH3-49_IGHD2-2*01_IGHJ6*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTREGYCSSTSCYADYYYYYGMDVWGQGTTVTVSS

SEQ ID NO: 1680 - protein, 127 aa, Artificial Sequence
  gnl|Fabrus|VH3-49_IGHD2-8*01_IGHJ4*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTREGYCTNGVCYTDYFDYWGQGTLVTVSS

SEQ ID NO: 1681 - protein, 127 aa, Artificial Sequence
  gnl|Fabrus|VH3-49_IGHD3-22*01_IGHJ4*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTREYYYDSSGYYYDYFDYWGQGTLVTVSS

SEQ ID NO: 1682 - protein, 132 aa, Artificial Sequence
  gnl|Fabrus|VH3-49_IGHD3-9*01_IGHJ6*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTREYYDILTGYYNDYYYYYGMDVWGQGTTVTVSS

SEQ ID NO: 1683 - protein, 123 aa, Artificial Sequence
  gnl|Fabrus|VH3-49_IGHD5-18*01_IGHJ4*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRGGYSYGYDYFDYWGQGTLVTVSS

SEQ ID NO: 1684 - protein, 124 aa, Artificial Sequence
  gnl|Fabrus|VH3-49_IGHD6-13*01_IGHJ4*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTREGYSSSWYDYFDYWGQGTLVTVSS

SEQ ID NO: 1685 - protein, 121 aa, Artificial Sequence
  gnl|Fabrus|VH3-49_IGHD7-27*01_IGHJ1*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRANWGAEYFQHWGQGTLVTVSS

SEQ ID NO: 1686 - protein, 124 aa, Artificial Sequence
  gnl|Fabrus|VH3-53_IGHD1-14*01_IGHJ6*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGYNRNHDYYYYYGMDVWGQGTTVTVSS

SEQ ID NO: 1687 - protein, 120 aa, Artificial Sequence
  gnl|Fabrus|VH3-53_IGHD1-7*01_IGHJ1*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGYNWNYAEYFQHWGQGTLVTVSS

SEQ ID NO: 1688 - protein, 125 aa, Artificial Sequence
  gnl|Fabrus|VH3-53_IGHD2-2*01_IGHJ2*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCAREGYCSSTSCYAYWYFDLWGRGTLVTVSS

SEQ ID NO: 1689 - protein, 124 aa, Artificial Sequence
  gnl|Fabrus|VH3-53_IGHD3-22*01_IGHJ3*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCAREYYYDSSGYYYDAFDVWGQGTMVTVSS

SEQ ID NO: 1690 - protein, 121 aa, Artificial Sequence
  gnl|Fabrus|VH3-53_IGHD4-23*01_IGHJ1*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDDYGGNSAEYFQHWGQGTLVTVSS

SEQ ID NO: 1691 - protein, 120 aa, Artificial Sequence
  gnl|Fabrus|VH3-53_IGHD5-5*01_IGHJ4*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGGYSYGYDYFDYWGQGTLVTVSS

SEQ ID NO: 1692 - protein, 121 aa, Artificial Sequence
  gnl|Fabrus|VH3-53_IGHD6-13*01_IGHJ3*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCAREGYSSSWYDAFDVWGQGTMVTVSS

SEQ ID NO: 1693 - protein, 117 aa, Artificial Sequence
  gnl|Fabrus|VH3-53_IGHD7-27*01_IGHJ4*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARANWGDYFDYWGQGTLVTVSS

SEQ ID NO: 1694 - protein, 121 aa, Artificial Sequence
  gnl|Fabrus|VH3-64_IGHD1-26*01_IGHJ4*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCARGYSGSYYDYFDYWGQGTLVTVSS

SEQ ID NO: 1695 - protein, 125 aa, Artificial Sequence
  gnl|Fabrus|VH3-64_IGHD1-7*01_IGHJ6*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCARGYNWNYDYYYYYGMDVWGQGTTVTVSS

SEQ ID NO: 1696 - protein, 126 aa, Artificial Sequence
  gnl|Fabrus|VH3-64_IGHD2-2*01_IGHJ5*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCAREGYCSSTSCYADNWFDSWGQGTLVTVSS

SEQ ID NO: 1697 - protein, 125 aa, Artificial Sequence
  gnl|Fabrus|VH3-64_IGHD3-3*01_IGHJ4*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCAREYYDFWSGYYTDYFDYWGQGTLVTVSS

SEQ ID NO: 1698 - protein, 120 aa, Artificial Sequence
  gnl|Fabrus|VH3-64_IGHD4-17*01_IGHJ4*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCARDDYGDYDYFDYWGQGTLVTVSS

SEQ ID NO: 1699 - protein, 122 aa, Artificial Sequence
  gnl|Fabrus|VH3-64_IGHD5-12*01_IGHJ4*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCARGGYSGYDYDYFDYWGQGTLVTVSS

SEQ ID NO: 1700 - protein, 123 aa, Artificial Sequence
  gnl|Fabrus|VH3-64_IGHD6-19*01_IGHJ1*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCAREGYSSGWYAEYFQHWGQGTLVTVSS

SEQ ID NO: 1701 - protein, 118 aa, Artificial Sequence
  gnl|Fabrus|VH3-64_IGHD7-27*01_IGHJ4*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCARANWGDYFDYWGQGTLVTVSS

SEQ ID NO: 1702 - protein, 121 aa, Artificial Sequence
  gnl|Fabrus|VH3-66_IGHD6-6*01_IGHJ1*01 Protein
EVQLVESGGGLIQPGGSLRLSCAASGFTVSSNYMSWVRQAPGKGLEWVSVIYSCGSTYYADSVKGRFTISRDNSKNTLYLQMNSLRAEDTAVYYCAREEYSSSSAEYFQHWGQGTLVTVSS

SEQ ID NO: 1703 - protein, 120 aa, Artificial Sequence
  gnl|Fabrus|VH3-7_IGHD1-20*01_IGHJ3*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARGYNWNDDAFDVWGQGTMVTVSS

SEQ ID NO: 1704 - protein, 125 aa, Artificial Sequence
  gnl|Fabrus|VH3-7_IGHD1-7*01_IGHJ6*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARGYNWNYDYYYYYGMDVWGQGTTVTVSS

SEQ ID NO: 1705 - protein, 125 aa, Artificial Sequence
  gnl|Fabrus|VH3-7_IGHD2-21*01_IGHJ5*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREAYCGGDCYSDNWFDSWGQGTLVTVSS

SEQ ID NO: 1706 - protein, 129 aa, Artificial Sequence
  gnl|Fabrus|VH3-7_IGHD2-8*01_IGHJ6*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREDIVLMVYAIHYYYYYGMDVWGQGTTVTVSS

SEQ ID NO: 1707 - protein, 125 aa, Artificial Sequence
  gnl|Fabrus|VH3-7_IGHD3-22*01_IGHJ3*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREYYYDSSGYYYDAFDVWGQGTMVTVSS

SEQ ID NO: 1708 - protein, 130 aa, Artificial Sequence
  gnl|Fabrus|VH3-7_IGHD3-9*01_IGHJ6*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREYYDILTGYYNDYYYYYGMDVWGQGTTVTVSS

SEQ ID NO: 1709 - protein, 120 aa, Artificial Sequence
  gnl|Fabrus|VH3-7_IGHD4-17*01_IGHJ4*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDDYGDYDYFDYWGQGTLVTVSS

SEQ ID NO: 1710 - protein, 122 aa, Artificial Sequence
  gnl|Fabrus|VH3-7_IGHD5-12*01_IGHJ4*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARGGYSGYDYDYFDYWGQGTLVTVSS

SEQ ID NO: 1711 - protein, 121 aa, Artificial Sequence
  gnl|Fabrus|VH3-7_IGHD5-24*01_IGHJ4*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREVEMATINYFDYWGQGTLVTVSS

SEQ ID NO: 1712 - protein, 127 aa, Artificial Sequence
  gnl|Fabrus|VH3-7_IGHD6-19*01_IGHJ6*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREGYSSGWYDYYYYYGMDVWGQGTTVTVSS

SEQ ID NO: 1713 - protein, 122 aa, Artificial Sequence
  gnl|Fabrus|VH3-7_IGHD6-6*01_IGHJ1*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREEYSSSSAEYFQHWGQGTLVTVSS

SEQ ID NO: 1714 - protein, 119 aa, Artificial Sequence
  gnl|Fabrus|VH3-7_IGHD7-27*01_IGHJ2*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARANWGYWYFDLWGRGTLVTVSS

SEQ ID NO: 1715 - protein, 122 aa, Artificial Sequence
  gnl|Fabrus|VH3-72_IGHD1-1*01_IGHJ4*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARGYNWNDDYFDYWGQGTLVTVSS

SEQ ID NO: 1716 - protein, 128 aa, Artificial Sequence
  gnl|Fabrus|VH3-72_IGHD2-15*01_IGHJ1*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCAREGYCSGGSCYSAEYFQHWGQGTLVTVSS

SEQ ID NO: 1717 - protein, 127 aa, Artificial Sequence
  gnl|Fabrus|VH3-72_IGHD3-22*01_IGHJ4*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCAREYYYDSSGYYYDYFDYWGQGTLVTVSS

SEQ ID NO: 1718 - protein, 132 aa, Artificial Sequence
  gnl|Fabrus|VH3-72_IGHD3-9*01_IGHJ6*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCAREYYDILTGYYNDYYYYYGMDVWGQGTTVTVSS

SEQ ID NO: 1719 - protein, 124 aa, Artificial Sequence
  gnl|Fabrus|VH3-72_IGHD4-23*01_IGHJ2*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARDDYGGNSYWYFDLWGRGTLVTVSS

SEQ ID NO: 1720 - protein, 123 aa, Artificial Sequence
  gnl|Fabrus|VH3-72_IGHD5-18*01_IGHJ4*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARGGYSYGYDYFDYWGQGTLVTVSS

SEQ ID NO: 1721 - protein, 128 aa, Artificial Sequence
  gnl|Fabrus|VH3-72_IGHD5-18*01_IGHJ4*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARGRDGYNYDYYYYYGMDVWGQGTTVTVSS

SEQ ID NO: 1722 - protein, 124 aa, Artificial Sequence
  gnl|Fabrus|VH3-72_IGHD6-6*01_IGHJ1*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCAREEYSSSSAEYFQHWGQGTLVTVSS

SEQ ID NO: 1723 - protein, 121 aa, Artificial Sequence
  gnl|Fabrus|VH3-72_IGHD7-27*01_IGHJ2*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARANWGYWYFDLWGRGTLVTVSS

SEQ ID NO: 1724 - protein, 123 aa, Artificial Sequence
  gnl|Fabrus|VH3-73_IGHD1-1*01_IGHJ5*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRRYNWNDDNWFDSWGQGTLVTVSS

SEQ ID NO: 1725 - protein, 128 aa, Artificial Sequence
  gnl|Fabrus|VH3-73_IGHD2-8*01_IGHJ2*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRQGYCTNGVCYTYWYFDLWGRGTLVTVSS

SEQ ID NO: 1726 - protein, 127 aa, Artificial Sequence
  gnl|Fabrus|VH3-73_IGHD3-22*01_IGHJ4*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRQYYYDSSGYYYDYFDYWGQGTLVTVSS

SEQ ID NO: 1727 - protein, 132 aa, Artificial Sequence
  gnl|Fabrus|VH3-73_IGHD3-9*01_IGHJ6*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRQYYDILTGYYNDYYYYYGMDVWGQGTTVTVSS

SEQ ID NO: 1728 - protein, 127 aa, Artificial Sequence
  gnl|Fabrus|VH3-73_IGHD4-11*01_IGHJ6*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRHDYSNYDYYYYYGMDVWGQGTTVTVSS

SEQ ID NO: 1729 - protein, 124 aa, Artificial Sequence
  gnl|Fabrus|VH3-73_IGHD4-23*01_IGHJ5*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRHDYGGNSDNWFDSWGQGTLVTVSS

SEQ ID NO: 1730 - protein, 124 aa, Artificial Sequence
  gnl|Fabrus|VH3-73_IGHD5-12*01_IGHJ4*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRRGYSGYDYDYFDYWGQGTLVTVSS

SEQ ID NO: 1731 - protein, 125 aa, Artificial Sequence
  gnl|Fabrus|VH3-73_IGHD6-19*01_IGHJ1*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRQGYSSGWYAEYFQHWGQGTLVTVSS

SEQ ID NO: 1732 - protein, 121 aa, Artificial Sequence
  gnl|Fabrus|VH3-73_IGHD7-27*01_IGHJ5*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRPNWGDNWFDSWGQGTLVTVSS

SEQ ID NO: 1733 - protein, 125 aa, Artificial Sequence
  gnl|Fabrus|VH3-74_IGHD1-1*01_IGHJ6*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARGYNWNDDYYYYYGMDVWGQGTTVTVSS

SEQ ID NO: 1734 - protein, 121 aa, Artificial Sequence
  gnl|Fabrus|VH3-74_IGHD1-26*01_IGHJ4*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARGYSGSYYDYFDYWGQGTLVTVSS

SEQ ID NO: 1735 - protein, 126 aa, Artificial Sequence
  gnl|Fabrus|VH3-74_IGHD2-2*01_IGHJ5*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCAREGYCSSTSCYADNWFDSWGQGTLVTVSS

SEQ ID NO: 1736 - protein, 126 aa, Artificial Sequence
  gnl|Fabrus|VH3-74_IGHD3-22*01_IGHJ5*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCAREYYYDSSGYYYDNWFDSWGQGTLVTVSS

SEQ ID NO: 1737 - protein, 121 aa, Artificial Sequence
  gnl|Fabrus|VH3-74_IGHD4-17*01_IGHJ1*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARDDYGDYAEYFQHWGQGTLVTVSS

SEQ ID NO: 1738 - protein, 122 aa, Artificial Sequence
  gnl|Fabrus|VH3-74_IGHD5-12*01_IGHJ4*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARGGYSGYDYDYFDYWGQGTLVTVSS

SEQ ID NO: 1739 - protein, 122 aa, Artificial Sequence
  gnl|Fabrus|VH3-74_IGHD6-6*01_IGHJ1*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCAREEYSSSSAEYFQHWGQGTLVTVSS

SEQ ID NO: 1740 - protein, 118 aa, Artificial Sequence
  gnl|Fabrus|VH3-74_IGHD7-27*01_IGHJ4*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARANWGDYFDYWGQGTLVTVSS

SEQ ID NO: 1741 - protein, 126 aa, Artificial Sequence
  gnl|Fabrus|VH3-9_IGHD1-1*01_IGHJ6*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDRYNWNDDYYYYYGMDVWGQGTTVTVSS

SEQ ID NO: 1742 - protein, 122 aa, Artificial Sequence
  gnl|Fabrus|VH3-9_IGHD1-7*01_IGHJ5*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDRYNWNYDNWFDSWGQGTLVTVSS

SEQ ID NO: 1743 - protein, 126 aa, Artificial Sequence
  gnl|Fabrus|VH3-9_IGHD2-2*01_IGHJ4*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDRGYCSSTSCYADYFDYWGQGTLVTVSS

SEQ ID NO: 1744 - protein, 133 aa, Artificial Sequence
  gnl|Fabrus|VH3-9_IGHD3-16*01_IGHJ6*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDRYYDYVWGSYAYTDYYYYYGMDVWGQGTTVTVSS

SEQ ID NO: 1745 - protein, 126 aa, Artificial Sequence
  gnl|Fabrus|VH3-9_IGHD3-22*01_IGHJ4*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDRYYYDSSGYYYDYFDYWGQGTLVTVSS

SEQ ID NO: 1746 - protein, 121 aa, Artificial Sequence
  gnl|Fabrus|VH3-9_IGHD4-11*01_IGHJ4*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDSDYSNYDYFDYWGQGTLVTVSS

SEQ ID NO: 1747 - protein, 123 aa, Artificial Sequence
  gnl|Fabrus|VH3-9_IGHD5-24*01_IGHJ1*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDSRDGYNYAEYFQHWGQGTLVTVSS

SEQ ID NO: 1748 - protein, 122 aa, Artificial Sequence
  gnl|Fabrus|VH3-9_IGHD6-13*01_IGHJ4*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGYSSSWYDYFDYWGQGTLVTVSS

SEQ ID NO: 1749 - protein, 126 aa, Artificial Sequence
  gnl|Fabrus|VH3-9_IGHD6-25*01_IGHJ6*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGYSSGYDYYYYYGMDVWGQGTTVTVSS

SEQ ID NO: 1750 - protein, 120 aa, Artificial Sequence
  gnl|Fabrus|VH3-9_IGHD7-27*01_IGHJ2*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDTNWGYWYFDLWGRGTLVTVSS

SEQ ID NO: 1751 - protein, 121 aa, Artificial Sequence
  gnl|Fabrus|VH4-28_IGHD1-20*01_IGHJ1*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARRYNWNDAEYFQHWGQGTLVTVSS

SEQ ID NO: 1752 - protein, 125 aa, Artificial Sequence
  gnl|Fabrus|VH4-28_IGHD1-7*01_IGHJ6*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARRYNWNYDYYYYYGMDVWGQGTTVTVSS

SEQ ID NO: 1753 - protein, 130 aa, Artificial Sequence
  gnl|Fabrus|VH4-28_IGHD2-15*01_IGHJ6*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARKGYCSGGSCYSDYYYYYGMDVWGQGTTVTVSS

SEQ ID NO: 1754 - protein, 128 aa, Artificial Sequence
  gnl|Fabrus|VH4-28_IGHD3-16*01_IGHJ2*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARKYYDYVWGSYAYTYWYFDLWGRGTLVTVSS

SEQ ID NO: 1755 - protein, 130 aa, Artificial Sequence
  gnl|Fabrus|VH4-28_IGHD3-9*01_IGHJ6*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARKYYDILTGYYNDYYYYYGMDVWGQGTTVTVSS

SEQ ID NO: 1756 - protein, 120 aa, Artificial Sequence
  gnl|Fabrus|VH4-28_IGHD4-4*01_IGHJ4*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARNDYSNYDYFDYWGQGTLVTVSS

SEQ ID NO: 1757 - protein, 122 aa, Artificial Sequence
  gnl|Fabrus|VH4-28_IGHD5-5*01_IGHJ1*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARSGYSYGYAEYFQHWGQGTLVTVSS

SEQ ID NO: 1758 - protein, 122 aa, Artificial Sequence
  gnl|Fabrus|VH4-28_IGHD6-13*01_IGHJ4*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARKGYSSSWYDYFDYWGQGTLVTVSS

SEQ ID NO: 1759 - protein, 119 aa, Artificial Sequence
  gnl|Fabrus|VH4-28_IGHD7-27*01_IGHJ1*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARTNWGAEYFQHWGQGTLVTVSS

SEQ ID NO: 1760 - protein, 123 aa, Artificial Sequence
  gnl|Fabrus|VH4-31_IGHD1-26*01_IGHJ2*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARGYSGSYYYWYFDLWGRGTLVTVSS

SEQ ID NO: 1761 - protein, 127 aa, Artificial Sequence
  gnl|Fabrus|VH4-31_IGHD2-15*01_IGHJ2*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREGYCSGGSCYSYWYFDLWGRGTLVTVSS

SEQ ID NO: 1762 - protein, 131 aa, Artificial Sequence
  gnl|Fabrus|VH4-31_IGHD2-2*01_IGHJ6*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREGYCSSTSCYADYYYYYGMDVWGQGTTVTVSS

SEQ ID NO: 1763 - protein, 126 aa, Artificial Sequence
  gnl|Fabrus|VH4-31_IGHD3-10*01_IGHJ4*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREYYYGSGSYYNDYFDYWGQGTLVTVSS

SEQ ID NO: 1764 - protein, 131 aa, Artificial Sequence
  gnl|Fabrus|VH4-31_IGHD3-9*01_IGHJ6*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREYYDILTGYYNDYYYYYGMDVWGQGTTVTVSS

SEQ ID NO: 1765 - protein, 122 aa, Artificial Sequence
  gnl|Fabrus|VH4-31_IGHD4-17*01_IGHJ5*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDDYGDYDNWFDSWGQGTLVTVSS

SEQ ID NO: 1766 - protein, 123 aa, Artificial Sequence
  gnl|Fabrus|VH4-31_IGHD5-12*01_IGHJ4*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARGGYSGYDYDYFDYWGQGTLVTVSS

SEQ ID NO: 1767 - protein, 123 aa, Artificial Sequence
  gnl|Fabrus|VH4-31_IGHD6-13*01_IGHJ4*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREGYSSSWYDYFDYWGQGTLVTVSS

SEQ ID NO: 1768 - protein, 123 aa, Artificial Sequence
  gnl|Fabrus|VH4-31_IGHD6-6*01_IGHJ1*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREEYSSSSAEYFQHWGQGTLVTVSS

SEQ ID NO: 1769 - protein, 120 aa, Artificial Sequence
  gnl|Fabrus|VH4-31_IGHD7-27*01_IGHJ5*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARANWGDNWFDSWGQGTLVTVSS

SEQ ID NO: 1770 - protein, 119 aa, Artificial Sequence
  gnl|Fabrus|VH4-34_IGHD1-7*01_IGHJ4*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGYNWNYDYFDYWGQGTLVTVSS

SEQ ID NO: 1771 - protein, 124 aa, Artificial Sequence
  gnl|Fabrus|VH4-34_IGHD2-2*01_IGHJ4*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGYCSSTSCYADYFDYWGQGTLVTVSS

SEQ ID NO: 1772 - protein, 126 aa, Artificial Sequence
  gnl|Fabrus|VH4-34_IGHD3-16*01_IGHJ4*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGYYDYVWGSYAYTDYFDYWGQGTLVTVSS

SEQ ID NO: 1773 - protein, 129 aa, Artificial Sequence
  gnl|Fabrus|VH4-34_IGHD3-22*01_IGHJ6*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGYYYDSSGYYYDYYYYYGMDVWGQGTTVTVSS

SEQ ID NO: 1774 - protein, 119 aa, Artificial Sequence
  gnl|Fabrus|VH4-34_IGHD4-17*01_IGHJ4*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGDYGDYDYFDYWGQGTLVTVSS

SEQ ID NO: 1775 - protein, 121 aa, Artificial Sequence
  gnl|Fabrus|VH4-34_IGHD5-12*01_IGHJ4*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGYSGYDYDYFDYWGQGTLVTVSS

SEQ ID NO: 1776 - protein, 121 aa, Artificial Sequence
  gnl|Fabrus|VH4-34_IGHD6-13*01_IGHJ4*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGYSSSWYDYFDYWGQGTLVTVSS

SEQ ID NO: 1777 - protein, 125 aa, Artificial Sequence
  gnl|Fabrus|VH4-34_IGHD6-25*01_IGHJ6*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGYSSGYDYYYYYGMDVWGQGTTVTVSS

SEQ ID NO: 1778 - protein, 125 aa, Artificial Sequence
  gnl|Fabrus|VH4-34_IGHD6-6*01_IGHJ6*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGEYSSSSDYYYYYGMDVWGQGTTVTVSS

SEQ ID NO: 1779 - protein, 117 aa, Artificial Sequence
  gnl|Fabrus|VH4-34_IGHD7-27*01_IGHJ4*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARANWGDYFDYWGQGTLVTVSS

SEQ ID NO: 1780 - protein, 122 aa, Artificial Sequence
  gnl|Fabrus|VH4-39_IGHD1-14*01_IGHJ1*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARRYNRNHAEYFQHWGQGTLVTVSS

SEQ ID NO: 1781 - protein, 126 aa, Artificial Sequence
  gnl|Fabrus|VH4-39_IGHD1-20*01_IGHJ6*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARRYNWNDDYYYYYGMDVWGQGTTVTVSS

SEQ ID NO: 1782 - protein, 125 aa, Artificial Sequence
  gnl|Fabrus|VH4-39_IGHD2-21*01_IGHJ3*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQAYCGGDCYSDAFDVWGQGTMVTVSS

SEQ ID NO: 1783 - protein, 126 aa, Artificial Sequence
  gnl|Fabrus|VH4-39_IGHD3-10*01_IGHJ4*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQYYYGSGSYYNDYFDYWGQGTLVTVSS

SEQ ID NO: 1784 - protein, 129 aa, Artificial Sequence
  gnl|Fabrus|VH4-39_IGHD3-16*01_IGHJ2*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQYYDYVWGSYAYTYWYFDLWGRGTLVTVSS

SEQ ID NO: 1785 - protein, 131 aa, Artificial Sequence
  gnl|Fabrus|VH4-39_IGHD3-9*01_IGHJ6*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQYYDILTGYYNDYYYYYGMDVWGQGTTVTVSS

SEQ ID NO: 1786 - protein, 123 aa, Artificial Sequence
  gnl|Fabrus|VH4-39_IGHD4-23*01_IGHJ2*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHDYGGNSYWYFDLWGRGTLVTVSS

SEQ ID NO: 1787 - protein, 123 aa, Artificial Sequence
  gnl|Fabrus|VH4-39_IGHD5-12*01_IGHJ4*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARRGYSGYDYDYFDYWGQGTLVTVSS

SEQ ID NO: 1788 - protein, 123 aa, Artificial Sequence
  gnl|Fabrus|VH4-39_IGHD6-6*01_IGHJ1*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQEYSSSSAEYFQHWGQGTLVTVSS

SEQ ID NO: 1789 - protein, 119 aa, Artificial Sequence
  gnl|Fabrus|VH4-4_IGHD1-20*01_IGHJ3*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCARGYNWNDDAFDVWGQGTMVTVSS

SEQ ID NO: 1790 - protein, 124 aa, Artificial Sequence
  gnl|Fabrus|VH4-4_IGHD2-8*01_IGHJ4*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCAREGYCTNGVCYTDYFDYWGQGTLVTVSS

SEQ ID NO: 1791 - protein, 125 aa, Artificial Sequence
  gnl|Fabrus|VH4-4_IGHD3-22*01_IGHJ2*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCAREYYYDSSGYYYYWYFDLWGRGTLVTVSS

SEQ ID NO: 1792 - protein, 120 aa, Artificial Sequence
  gnl|Fabrus|VH4-4_IGHD4-23*01_IGHJ4*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCARDDYGGNSDYFDYWGQGTLVTVSS

SEQ ID NO: 1793 - protein, 122 aa, Artificial Sequence
  gnl|Fabrus|VH4-4_IGHD5-12*01_IGHJ5*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCARGGYSGYDYDNWFDSWGQGTLVTVSS

SEQ ID NO: 1794 - protein, 120 aa, Artificial Sequence
  gnl|Fabrus|VH4-4_IGHD6-6*01_IGHJ4*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCAREEYSSSSDYFDYWGQGTLVTVSS

SEQ ID NO: 1795 - protein, 122 aa, Artificial Sequence
  gnl|Fabrus|VH4-4_IGHD7-27*01_IGHJ6*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCARANWGDYYYYYGMDVWGQGTTVTVSS

SEQ ID NO: 1796 - protein, 120 aa, Artificial Sequence
  gnl|Fabrus|VH4-59_IGHD6-25*01_IGHJ3*01 Protein
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAREGYSSGYDAFDVWGQGTMVTVSS

SEQ ID NO: 1797 - protein, 120 aa, Artificial Sequence
  gnl|Fabrus|VH5-51_IGHD1-14*01_IGHJ4*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRYNRNHDYFDYWGQGTLVTVSS

SEQ ID NO: 1798 - protein, 126 aa, Artificial Sequence
  gnl|Fabrus|VH5-51_IGHD1-26*01_IGHJ6*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRYSGSYYDYYYYYGMDVWGQGTTVTVSS

SEQ ID NO: 1799 - protein, 125 aa, Artificial Sequence
  gnl|Fabrus|VH5-51_IGHD2-8*01_IGHJ4*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQGYCTNGVCYTDYFDYWGQGTLVTVSS

SEQ ID NO: 1800 - protein, 130 aa, Artificial Sequence
  gnl|Fabrus|VH5-51_IGHD3-10*01_IGHJ6*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQYYYGSGSYYNDYYYYYGMDVWGQGTTVTVSS

SEQ ID NO: 1801 - protein, 125 aa, Artificial Sequence
  gnl|Fabrus|VH5-51_IGHD3-3*01_IGHJ4*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQYYDFWSGYYTDYFDYWGQGTLVTVSS

SEQ ID NO: 1802 - protein, 120 aa, Artificial Sequence
  gnl|Fabrus|VH5-51_IGHD4-17*01_IGHJ4*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARHDYGDYDYFDYWGQGTLVTVSS

SEQ ID NO: 1803 - protein, 121 aa, Artificial Sequence
  gnl|Fabrus|VH5-51_IGHD5-18*01>3_IGHJ4*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYGYDYFDYWGQGTLVTVSS

SEQ ID NO: 1804 - protein, 121 aa, Artificial Sequence
  gnl|Fabrus|VH5-51_IGHD5-18*01>1_IGHJ4*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVDTAMVNYFDYWGQGTLVTVSS

SEQ ID NO: 1805 - protein, 121 aa, Artificial Sequence
  gnl|Fabrus|VH5-51_IGHD6-25*01_IGHJ4*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQGYSSGYDYFDYWGQGTLVTVSS

SEQ ID NO: 1806 - protein, 118 aa, Artificial Sequence
  gnl|Fabrus|VH5-51_IGHD7-27*01_IGHJ4*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQLTGDYFDYWGQGTLVTVSS

SEQ ID NO: 1807 - protein, 123 aa, Artificial Sequence
  gnl|Fabrus|VH6-1_IGHD1-1*01_IGHJ4*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGYNWNDDYFDYWGQGTLVTVSS

SEQ ID NO: 1808 - protein, 128 aa, Artificial Sequence
  gnl|Fabrus|VH6-1_IGHD1-1*01_IGHJ4*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGYNWNDDYYYYYGMDVWGQGTTVTVSS

SEQ ID NO: 1809 - protein, 128 aa, Artificial Sequence
  gnl|Fabrus|VH6-1_IGHD2-15*01_IGHJ4*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREGYCSGGSCYSDYFDYWGQGTLVTVSS

SEQ ID NO: 1810 - protein, 132 aa, Artificial Sequence
  gnl|Fabrus|VH6-1_IGHD2-21*01_IGHJ6*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREAYCGGDCYSDYYYYYGMDVWGQGTTVTVSS

SEQ ID NO: 1811 - protein, 131 aa, Artificial Sequence
  gnl|Fabrus|VH6-1_IGHD3-16*01_IGHJ5*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREYYDYVWGSYAYTDNWFDSWGQGTLVTVSS

SEQ ID NO: 1812 - protein, 128 aa, Artificial Sequence
  gnl|Fabrus|VH6-1_IGHD3-3*01_IGHJ4*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREYYDFWSGYYTDYFDYWGQGTLVTVSS

SEQ ID NO: 1813 - protein, 128 aa, Artificial Sequence
  gnl|Fabrus|VH6-1_IGHD4-11*01_IGHJ6*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDDYSNYDYYYYYGMDVWGQGTTVTVSS

SEQ ID NO: 1814 - protein, 124 aa, Artificial Sequence
  gnl|Fabrus|VH6-1_IGHD4-23*01_IGHJ4*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDDYGGNSDYFDYWGQGTLVTVSS

SEQ ID NO: 1815 - protein, 124 aa, Artificial Sequence
  gnl|Fabrus|VH6-1_IGHD5-5*01_IGHJ4*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGGYSYGYDYFDYWGQGTLVTVSS

SEQ ID NO: 1816 - protein, 125 aa, Artificial Sequence
  gnl|Fabrus|VH6-1_IGHD6-13*01_IGHJ4*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREGYSSSWYDYFDYWGQGTLVTVSS

SEQ ID NO: 1817 - protein, 129 aa, Artificial Sequence
  gnl|Fabrus|VH6-1_IGHD6-25*01_IGHJ6*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREGYSSGYDYYYYYGMDVWGQGTTVTVSS

SEQ ID NO: 1818 - protein, 121 aa, Artificial Sequence
  gnl|Fabrus|VH6-1_IGHD7-27*01_IGHJ4*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARANWGDYFDYWGQGTLVTVSS

SEQ ID NO: 1819 - protein, 120 aa, Artificial Sequence
  gnl|Fabrus|VH7-81_IGHD1-14*01_IGHJ4*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARWYNRNHDYFDYWGQGTLVTVSS

SEQ ID NO: 1820 - protein, 125 aa, Artificial Sequence
  gnl|Fabrus|VH7-81_IGHD2-21*01_IGHJ2*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARYAYCGGDCYSYWYFDLWGRGTLVTVSS

SEQ ID NO: 1821 - protein, 129 aa, Artificial Sequence
  gnl|Fabrus|VH7-81_IGHD2-21*01_IGHJ6*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARYAYCGGDCYSDYYYYYGMDVWGQGTTVTVSS

SEQ ID NO: 1822 - protein, 132 aa, Artificial Sequence
  gnl|Fabrus|VH7-81_IGHD3-16*01_IGHJ6*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARYYYDYVWGSYAYTDYYYYYGMDVWGQGTTVTVSS

SEQ ID NO: 1823 - protein, 122 aa, Artificial Sequence
  gnl|Fabrus|VH7-81_IGHD4-23*01_IGHJ1*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARYDYGGNSAEYFQHWGQGTLVTVSS

SEQ ID NO: 1824 - protein, 127 aa, Artificial Sequence
  gnl|Fabrus|VH7-81_IGHD5-12*01_IGHJ6*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARCGYSGYDYDYYYYYGMDVWGQGTTVTVSS

SEQ ID NO: 1825 - protein, 121 aa, Artificial Sequence
  gnl|Fabrus|VH7-81_IGHD6-25*01_IGHJ4*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARYGYSSGYDYFDYWGQGTLVTVSS

SEQ ID NO: 1826 - protein, 118 aa, Artificial Sequence
  gnl|Fabrus|VH7-81_IGHD7-27*01_IGHJ4*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARSNWGDYFDYWGQGTLVTVSS

SEQ ID NO: 1827 - protein, 108 aa, Artificial Sequence
  gnl|Fabrus|A14_IGKJ1*01 Protein
DVVMTQSPAFLSVTPGEKVTITCQASEGIGNYLYWYQQKPDQAPKLLIKYASQSISGVPSRFSGSGSGTDFTFTISSLEAEDAATYYCQQGNKHPQWTFGQGTKVEIK

SEQ ID NO: 1828 - protein, 113 aa, Artificial Sequence
  gnl|Fabrus|A17_IGKJ1*01 Protein
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPPWTFGQGTKVEIK

SEQ ID NO: 1829 - protein, 113 aa, Artificial Sequence
  gnl|Fabrus|A2_IGKJ1*01 Protein
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPPWTFGQGTKVEIK

SEQ ID NO: 1830 - protein, 108 aa, Artificial Sequence
  gnl|Fabrus|A20_IGKJ1*01 Protein
DIQMTQSPSSLSASVGDRVTITCRASQGISNYLAWYQQKPGKVPKLLIYAASTLQSGVPSRFSGSGSGTDFTLTISSLQPEDVATYYCQKYNSAPPWTFGQGTKVEIK

SEQ ID NO: 1831 - protein, 113 aa, Artificial Sequence
  gnl|Fabrus|A23_IGKJ1*01 Protein
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPQWTFGQGTKVEIK

SEQ ID NO: 1832 - protein, 108 aa, Artificial Sequence
  gnl|Fabrus|A26_IGKJ1*01 Protein
EIVLTQSPDFQSVTPKEKVTITCRASQSIGSSLHWYQQKPDQSPKLLIKYASQSFSGVPSRFSGSGSGTDFTLTINSLEAEDAATYYCHQSSSLPQWTFGQGTKVEIK

SEQ ID NO: 1833 - protein, 109 aa, Artificial Sequence
  gnl|Fabrus|A27_IGKJ1*01 Protein
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPWTFGQGTKVEIK

SEQ ID NO: 1834 - protein, 109 aa, Artificial Sequence
  gnl|Fabrus|A27_IGKJ3*01 Protein
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPFTFGPGTKVDIK

SEQ ID NO: 1835 - protein, 108 aa, Artificial Sequence
  gnl|Fabrus|A27_IGKJ3*01 Protein
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPPWTFGQGTKVEIK

SEQ ID NO: 1836 - protein, 108 aa, Artificial Sequence
  gnl|Fabrus|B2_IGKJ1*01 Protein
ETTLTQSPAFMSATPGDKVNISCKASQDIDDDMNWYQQKPGEAAIFIIQEATTLVPGIPPRFSGSGYGTDFTLTINNIESEDAAYYFCLQHDNFPLWTFGQGTKVEIK

SEQ ID NO: 1837 - protein, 108 aa, Artificial Sequence
  gnl|Fabrus|B2_IGKJ3*01 Protein
ETTLTQSPAFMSATPGDKVNISCKASQDIDDDMNWYQQKPGEAAIFIIQEATTLVPGIPPRFSGSGYGTDFTLTINNIESEDAAYYFCLQHDNFPLFTFGPGTKVDIK

SEQ ID NO: 1838 - protein, 114 aa, Artificial Sequence
  gnl|Fabrus|B3_IGKJ1*01 Protein
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPWTFGQGTKVEIK

SEQ ID NO: 1839 - protein, 107 aa, Artificial Sequence [sequence omitted]

SEQ ID NO: 1840 - protein, 108 aa, Artificial Sequence
  gnl|Fabrus|L11_IGKJ1*01 Protein
AIQMTQSPSSLSASVGDRVTITCRASQGIRNDLGWYQQKPGKAPKLLIYAASSLQSGVPSRFSGSGSGTDFTLTISSLQPEDFATYYCLQDYNYPPWTFGQGTKVEIK

SEQ ID NO: 1841 - protein, 108 aa, Artificial Sequence
  gnl|Fabrus|L12_IGKJ1*01 Protein
DIQMTQSPSTLSASVGDRVTITCRASQSISSWLAWYQQKPGKAPKLLIYDASSLESGVPSRFSGSGSGTEFTLTISSLQPDDFATYYCQQYNSYSPWTFGQGTKVEIK

SEQ ID NO: 1842 - protein, 108 aa, Artificial Sequence
  gnl|Fabrus|L14_IGKJ1*01 Protein
NIQMTQSPSAMSASVGDRVTITCRARQGISNYLAWFQQKPGKVPKHLIYAASSLQSGVPSRFSGSGSGTEFTLTISSLQPEDFATYYCLQHNSYPPWTFGQGTKVEIK

SEQ ID NO: 1843 - protein, 108 aa, Artificial Sequence
  gnl|Fabrus|L2_IGKJ1*01 Protein
EIVMTQSPATLSVSPGERATLSCRASQSVSSNLAWYQQKPGQAPRLLIYGASTRATGIPARFSGSGSGTEFTLTISSLQSEDFAVYYCQQYNNWPPWTFGQGTKVEIK

SEQ ID NO: 1844 - protein, 108 aa, Artificial Sequence
  gnl|Fabrus|L2_IGKJ1*01 Protein
DIQMIQSPSFLSASVGDRVSIICWASEGISSNLAWYLQKPGKSPKLFLYDAKDLHPGVSSRFSGRGSGTDFTLTIISLKPEDFAAYYCKQDFSYPPFTFGPGTKVDIK

SEQ ID NO: 1845 - protein, 108 aa, Artificial Sequence
  gnl|Fabrus|L23_IGKJ1*01 Protein
AIRMTQSPFSLSASVGDRVTITCWASQGISSYLAWYQQKPAKAPKLFIYYASSLQSGVPSRFSGSGSGTDYTLTISSLQPEDFATYYCQQYYSTPPWTFGQGTKVEIK

SEQ ID NO: 1846 - protein, 109 aa, Artificial Sequence
  gnl|Fabrus|L25_IGKJ1*01 Protein
EIVMTQSPATLSLSPGERATLSCRASQSVSSSYLSWYQQKPGQAPRLLIYGASTRATGIPARFSGSGSGTDFTLTISSLQPEDFAVYYCQQDYNLPPWTFGQGTKVEIK

SEQ ID NO: 1847 - protein, 109 aa, Artificial Sequence
  gnl|Fabrus|L25_IGKJ3*01 Protein
EIVMTQSPATLSLSPGERATLSCRASQSVSSSYLSWYQQKPGQAPRLLIYGASTRATGIPARFSGSGSGTDFTLTISSLQPEDFAVYYCQQDYNLPPFTFGPGTKVDIK

SEQ ID NO: 1848 - protein, 108 aa, Artificial Sequence
  gnl|Fabrus|L4/18a_IGKJ1*01 Protein
AIQLTQSPSSLSASVGDRVTITCRASQGISSALAWYQQKPGKAPKLLIYDASSLESGVPSRFSGSGSGTDFTLTISSLQPEDFATYYCQQFNSYPQWTFGQGTKVEIK

SEQ ID NO: 1849 - protein, 110 aa, Artificial Sequence
  gnl|Fabrus|L5_IGKJ1*01 Protein
DIQMTQSPSSVSASVGDRVTITCRASQGISSWLAWYQQKPGKAPKLLIYAASSLQSGVPSRFSGSGSGTDFTLTISSLQPEDFATYYCQQANSFPPWTFGQGTKVEIKRT

SEQ ID NO: 1850 - protein, 108 aa, Artificial Sequence
  gnl|Fabrus|L6_IGKJ1*01 Protein
EIVLTQSPATLSLSPGERATLSCRASQSVSSYLAWYQQKPGQAPRLLIYDASNRATGIPARFSGSGSGTDFTLTISSLEPEDFAVYYCQQRSNWPPWTFGQGTKVEIK

SEQ ID NO: 1851 - protein, 108 aa, Artificial Sequence
  gnl|Fabrus|L8_IGKJ1*01 Protein
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPWTFGQGTKVEIK

SEQ ID NO: 1852 - protein, 108 aa, Artificial Sequence
  gnl|Fabrus|L9_IGKJ2*01 Protein
AIRMTQSPSSFSASTGDRVTITCRASQGISSYLAWYQQKPGKAPKLLIYAASTLQSGVPSRFSGSGSGTDFTLTISCLQSEDFATYYCQQYYSYPLYTFGQGTKLEIK

SEQ ID NO: 1853 - protein, 114 aa, Artificial Sequence
  gnl|Fabrus|O1_IGKJ1*01 Protein
DIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPSWTFGQGTKVEIK

SEQ ID NO: 1854 - protein, 108 aa, Artificial Sequence
  gnl|Fabrus|O12_IGKJ1*01 Protein
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK

SEQ ID NO: 1855 - protein, 108 aa, Artificial Sequence
  gnl|Fabrus|O18_IGKJ1*01 Protein
DIQMTQSPSSLSASVGDRVTITCQASQDISNYLNWYQQKPGKAPKLLIYDASNLETGVPSRFSGSGSGTDFTFTISSLQPEDIATYYCQQYDNLPPWTFGQGTKVEIK

SEQ ID NO: 1856 - protein, 106 aa, Artificial Sequence
  gnl|Fabrus|Anti CD-20 LC Protein
RIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELK

SEQ ID NO: 1857 - protein, 111 aa, Artificial Sequence
  gnl|Fabrus|V1-11_IGLJ2*01 Protein
QSVLTQPPSVSEAPRQRVTISCSGSSSNIGNNAVNWYQQLPGKAPKLLIYYDDLLPSGVSDRFSGSKSGTSASLAISGLQSEDEADYYCAAWDDSLNGPVVFGGGTKLTVL

SEQ ID NO: 1858 - protein, 112 aa, Artificial Sequence
  gnl|Fabrus|V1-13_IGLJ5*01 Protein
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSWVFGEGTELTVL

SEQ ID NO: 1859 - protein, 111 aa, Artificial Sequence
  gnl|Fabrus|V1-16_IGLJ6*01 Protein
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPNVFGSGTKVTVL

SEQ ID NO: 1860 - protein, 112 aa, Artificial Sequence
  gnl|Fabrus|V1-18_IGLJ2*01 Protein
QSVLTQPPSVSGAPGQRVTISCTGSSSNIGAGYVVHWYQQLPGTAPKLLIYGNSNRPSGVPDQFSGSKSGTSASLAITGLQSEDEADYYCKAWDNSLNAHVVFGGGTKLTVL

SEQ ID NO: 1861 - protein, 111 aa, Artificial Sequence
  gnl|Fabrus|V1-2_IGLJ7*01 Protein
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNFAVFGGGTQLTVL

SEQ ID NO: 1862 - protein, 111 aa, Artificial Sequence
  gnl|Fabrus|V1-20_IGLJ6*01 Protein
QAGLTQPPSVSKGLRQTATLTCTGNSNIVGNQGAAWLQQHQGHPPKLLSYRNNNRPSGISERFSASRSGNTASLTITGLQPEDEADYYCSALDSSLSAHNVFGSGTKVTVL

SEQ ID NO: 1863 - protein, 111 aa, Artificial Sequence
  gnl|Fabrus|V1-3_IGLJ1*01 Protein
QSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTFYVFGTGTKVTVL

SEQ ID NO: 1864 - protein, 111 aa, Artificial Sequence
  gnl|Fabrus|V1-4_IGLJ4*01 Protein
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLFVFGGGTQLIIL

SEQ ID NO: 1865 - protein, 111 aa, Artificial Sequence
  gnl|Fabrus|V1-5_IGLJ2*01 Protein
QSALTQPPSVSGSPGQSVTISCTGTSSDVGSYNRVSWYQQPPGTAPKLMIYEVSNRPSGVPDRFSGSKSGNTASLTISGLQAEDEADYYCSLYTSSSTFVVFGGGTKLTVL

SEQ ID NO: 1866 - protein, 111 aa, Artificial Sequence
  gnl|Fabrus|V1-7_IGLJ1*01 Protein
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTFYVFGTGTKVTVL

SEQ ID NO: 1867 - protein, 111 aa, Artificial Sequence
  gnl|Fabrus|V1-9_IGLJ6*01 Protein
QSALTQPPFVSGAPGQSVTISCTGTSSDVGDYDHVFWYQKRLSTTSRLLIYNVNTRPSGISDLFSGSKSGNMASLTISGLKSEVEANYHCSLYSSSYTFNVFGSGTKVTVL

SEQ ID NO: 1868 - protein, 107 aa, Artificial Sequence
  gnl|Fabrus|V2-1_IGLJ6*01 Protein
SYELTQPPSVSVSPGQTASITCSGDKLGDKYACWYQQKPGQSPVLVIYQDSKRPSGIPERFSGSNSGNTATLTISGTQAMDEADYYCQAWDSSTANVFGSGTKVTVL

SEQ ID NO: 1869 - protein, 109 aa, Artificial Sequence
  gnl|Fabrus|V2-11_IGLJ7*01 Protein
SYELTQPPSVSVSLGQMARITCSGEALPKKYAYWYQQKPGQFPVLVIYKDSERPSGIPERFSGSSSGTIVTLTISGVQAEDEADYYCLSADSSGTYPAVFGGGTQLTVL

SEQ ID NO: 1870 - protein, 109 aa, Artificial Sequence
  gnl|Fabrus|V2-13_IGLJ2*01 Protein
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHLVVFGGGTKLTVL

SEQ ID NO: 1871 - protein, 109 aa, Artificial Sequence
  gnl|Fabrus|V2-14_IGLJ4*01 Protein
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHPFVFGGGTQLIIL

SEQ ID NO: 1872 - protein, 107 aa, Artificial Sequence
  gnl|Fabrus|V2-15_IGLJ7*01 Protein
SYELTQLPSVSVSPGQTARITCSGDVLGENYADWYQQKPGQAPELVIYEDSERYPGIPERFSGSTSGNTTTLTISRVLTEDEADYYCLSGDEDNPAVFGGGTQLTVL

SEQ ID NO: 1873 - protein, 109 aa, Artificial Sequence
  gnl|Fabrus|V2-17_IGLJ2*01 Protein
SYELTQPPSVSVSPGQTARITCSGDALPKQYAYWYQQKPGQAPVLVIYKDSERPSGIPERFSGSSSGTTVTLTISGVQAEDEADYYCQSADSSGTYPVVFGGGTKLTVL

SEQ ID NO: 1874 - protein, 107 aa, Artificial Sequence
  gnl|Fabrus|V2-19_IGLJ4*01 Protein
SYELTQPSSVSVSPGQTARITCSGDVLAKKYARWFQQKPGQAPVLVIYKDSERPSGIPERFSGSSSGTTVTLTISGAQVEDEADYYCYSAADNNLFVFGGGTQLIIL

SEQ ID NO: 1875 - protein, 107 aa, Artificial Sequence
  gnl|Fabrus|V2-6_IGLJ4*01 Protein
SYELTQPLSVSVALGQTARITCGGNNIGSKNVHWYQQKPGQAPVLVIYRDSNRPSGIPERFSGSNSGNTATLTISRAQAGDEADYYCQVWDSSTAFVFGGGTQLIIL

SEQ ID NO: 1876 - protein, 109 aa, Artificial Sequence
  gnl|Fabrus|V2-7_IGLJ2*01 Protein
SYELTQPPSVSVSPGQTARITCSGDALPKKYAYWYQQKSGQAPVLVIYEDSKRPSGIPERFSGSSSGTMATLTISGAQVEDEADYYCYSTDSSGNHSVVFGGGTKLTVL

SEQ ID NO: 1877 - protein, 109 aa, Artificial Sequence
  gnl|Fabrus|V2-7_IGLJ7*01 Protein
SYELTQPPSVSVSPGQTARITCSGDALPKKYAYWYQQKSGQAPVLVIYEDSKRPSGIPERFSGSSSGTMATLTISGAQVEDEADYYCYSTDSSGNHSAVFGGGTQLTVL

SEQ ID NO: 1878 - protein, 109 aa, Artificial Sequence
  gnl|Fabrus|V2-8_IGLJ6*01 Protein
SYELTQPHSVSVATAQMARITCGGNNIGSKAVHWYQQKPGQDPVLVIYSDSNRPSGIPERFSGSNPGNTATLTISRIEAGDEADYYCQVWDSSSDHPNVFGSGTKVTVL

SEQ ID NO: 1879 - protein, 110 aa, Artificial Sequence
  gnl|Fabrus|V3-2_IGLJ4*01 Protein
QTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQFVFGGGTQLIIL

SEQ ID NO: 1880 - protein, 110 aa, Artificial Sequence
  gnl|Fabrus|V3-3_IGLJ7*01 Protein
QAVVTQEPSLTVSPGGTVTLTCGSSTGAVTSGHYPYWFQQKPGQAPRTLIYDTSNKHSWTPARFSGSLLGGKAALTLLGAQPEDEAEYYCLLSYSGARAVFGGGTQLTVL

SEQ ID NO: 1881 - protein, 111 aa, Artificial Sequence
  gnl|Fabrus|V3-4_IGLJ1*01 Protein
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 1882 - protein, 116 aa, Artificial Sequence
  gnl|Fabrus|V4-1_IGLJ4*01 Protein
QPVLTQPPSSSASPGESARLTCTLPSDINVGSYNIYWYQQKPGSPPRYLLYYYSDSDKGQGSGVPSRFSGSKDASANTGILLISGLQSEDEADYYCMIWPSNASFVFGGGTQLIIL

SEQ ID NO: 1883 - protein, 116 aa, Artificial Sequence
  gnl|Fabrus|V4-2_IGLJ4*01 Protein
QAVLTQPSSLSASPGASASLTCTLRSGINVGTYRIYWYQQKPGSPPQYLLRYKSDSDKQQGSGVPSRFSGSKDASANAGILLISGLQSEDEADYYCMIWHSSASFVFGGGTQLIIL

SEQ ID NO: 1884 - protein, 116 aa, Artificial Sequence
  gnl|Fabrus|V4-3_IGLJ4*01 Protein
QPVLTQPTSLSASPGASARLTCTLRSGINLGSYRIFWYQQKPESPPRYLLSYYSDSSKHQGSGVPSRFSGSKDASSNAGILVISGLQSEDEADYYCMIWHSSASFVFGGGTQLIIL

SEQ ID NO: 1885 - protein, 118 aa, Artificial Sequence
  gnl|Fabrus|V4-4_IGLJ5*01 Protein
QPVLTQPSSHSASSGASVRLTCMLSSGFSVGDFWIRWYQQKPGNPPRYLLYYHSDSNKGQGSGVPSRFSGSNDASANAGILRISGLQPEDEADYYCGTWHSNSKTHWVFGEGTELTVL

SEQ ID NO: 1886 - protein, 116 aa, Artificial Sequence
  gnl|Fabrus|V4-6_IGLJ4*01 Protein
RPVLTQPPSLSASPGATARLPCTLSSDLSVGGKNMFWYQQKPGSSPRLFLYHYSDSDKQLGPGVPSRVSGSKETSSNTAFLLISGLQPEDEADYYCQVYESSANFVFGGGTQLIIL

SEQ ID NO: 1887 - protein, 112 aa, Artificial Sequence
  gnl|Fabrus|V5-4_IGLJ2*01 Protein
QPVLTQSSSASASLGSSVKLTCTLSSGHSSYIIAWHQQQPGKAPRYLMKLEGSGSYNKGSGVPDRFSGSSSGADRYLTISNLQFEDEADYYCETWDSNTHVVFGGGTKLTVL

SEQ ID NO: 1888 - protein, 112 aa, Artificial Sequence
  gnl|Fabrus|V5-6_IGLJ1*01 Protein
QLVLTQSPSASASLGASVKLTCTLSSGHSSYAIAWHQQQPEKGPRYLMKLNSDGSHSKGDGIPDRFSGSSSGAERYLTISSLQSEDEADYYCQTWGTGIHYVFGTGTKVTVL

SEQ ID NO: 1889 - DNA, 13 bp, Artificial Sequence
  SfiI Restriction Site
  misc_feature (5)...(9): N = a or g or c or t
ggccnnnnnggcc

SEQ ID NO: 1890 - DNA, 8 bp, Artificial Sequence
  NotI Restriction Site
gcggccgc

SEQ ID NO: 1891 - DNA, 6 bp, Artificial Sequence
  HindIII Restriction Site
aagctt

SEQ ID NO: 1892 - DNA, 6 bp, Artificial Sequence
  EcoRI Restriction Site
gaattc

SEQ ID NO: 1893 - DNA, 6 bp, Artificial Sequence
  BamHI Restriction Site
ggatcc

SEQ ID NO: 1894 - DNA, 6 bp, Artificial Sequence
  EcoRV Restriction Site
ggatcc

SEQ ID NO: 1895 - DNA, 6 bp, Artificial Sequence
  PstI Restriction Site
ctgcag

SEQ ID NO: 1896 - DNA, 6 bp, Artificial Sequence
  SalI Restriction Site
gtcgac

SEQ ID NO: 1897 - DNA, 6 bp, Artificial Sequence
  SmaI Restriction Site
cccggg

SEQ ID NO: 1898 - DNA, 6 bp, Artificial Sequence
  XmaI Restriction Site
cccggg

SEQ ID NO: 1899 - DNA, 11 bp, Artificial Sequence
  BglI Restriction Site
  misc_feature (4)...(8): N = a or g or c or t
gccnnnnnggc

SEQ ID NO: 1900 - DNA, 6 bp, Artificial Sequence
  MfeI Restriction Site
caattg

SEQ ID NO: 1901 - DNA, 8 bp, Artificial Sequence
  5' End Sequence
ccatggca

SEQ ID NO: 1902 - DNA, 8 bp, Artificial Sequence
  5' End Sequence
ccatggcg

SEQ ID NO: 1903 - DNA, 5 bp, Artificial Sequence
  3' End Sequence
ctagc

SEQ ID NO: 1904 - DNA, 5 bp, Artificial Sequence
  3' End Sequence
ctact

SEQ ID NO: 1905 - protein, 111 aa, Artificial Sequence
  V3-4_IGLJ6*01 Protein
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGISNVFGSGTKVTVL

SEQ ID NO: 1906 - protein, 111 aa, Artificial Sequence
  V3-4_IGLJ7*01 beginning protein sequence
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGISAVFGGGTQLTVL

SEQ ID NO: 1907 - protein, 116 aa, Artificial Sequence
  V4-2_IGLJ6*01 Protein
QAVLTQPSSLSASPGASASLTCTLRSGINVGTYRIYWYQQKPGSPPQYLLRYKSDSDKQQGSGVPSRFSGSKDASANAGILLISGLQSEDEADYYCMIWHSSASNVFGSGTKVTVL

SEQ ID NO: 1908 - protein, 116 aa, Artificial Sequence
  V4-2_IGLJ7*01 Protein
QAVLTQPSSLSASPGASASLTCTLRSGINVGTYRIYWYQQKPGSPPQYLLRYKSDSDKQQGSGVPSRFSGSKDASANAGILLISGLQSEDEADYYCMIWHSSASAVFGGGTQLTVL

SEQ ID NO: 1909 - protein, 111 aa, Artificial Sequence
  V1-22_IGLJ6*01 Protein
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNHNVFGSGTKVTVL

SEQ ID NO: 1910 - protein, 111 aa, Artificial Sequence
  V1-22_IGLJ7*01 Protein
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNHAVFGGGTQLTVL

SEQ ID NO: 1911 - protein, 111 aa, Artificial Sequence
  V3-4_IGLJ4*01 Protein
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGISFVFGGGTQLIIL

SEQ ID NO: 1912 - protein, 116 aa, Artificial Sequence
  V4-2_IGLJ1*01 Protein
QAVLTQPSSLSASPGASASLTCTLRSGINVGTYRIYWYQQKPGSPPQYLLRYKSDSDKQQGSGVPSRFSGSKDASANAGILLISGLQSEDEADYYCMIWHSSASYVFGTGTKVTVL

SEQ ID NO: 1913 - protein, 111 aa, Artificial Sequence
  V3-4_IGLJ5*01 Proten
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGISWVFGEGTELTVL

SEQ ID NO: 1914 - protein, 111 aa, Artificial Sequence
  V1-11_IGLJ1*01 Protein
QSVLTQPPSVSEAPRQRVTISCSGSSSNIGNNAVNWYQQLPGKAPKLLIYYDDLLPSGVSDRFSGSKSGTSASLAISGLQSEDEADYYCAAWDDSLNGPYVFGTGTKVTVL

SEQ ID NO: 1915 - protein, 122 aa, Artificial Sequence
  VH1-18_IGHD1-1*01_IGHJ1*01 Protein
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAREGTTGTTAEYFQHWGQGTLVTVSS

SEQ ID NO: 1916 - protein, 111 aa, Artificial Sequence
  V3-4_IGLJ2*01 Protein
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGISVVFGGGTKLTVL

SEQ ID NO: 1917 - protein, 116 aa, Artificial Sequence
  V4-2_IGLJ5*01 Protein
QAVLTQPSSLSASPGASASLTCTLRSGINVGTYRIYWYQQKPGSPPQYLLRYKSDSDKQQGSGVPSRFSGSKDASANAGILLISGLQSEDEADYYCMIWHSSASWVFGEGTELTVL

SEQ ID NO: 1918 - protein, 110 aa, Artificial Sequence
  V3-3_IGLJ6*01 Protein
QAVVTQEPSLTVSPGGTVTLTCGSSTGAVTSGHYPYWFQQKPGQAPRTLIYDTSNKHSWTPARFSGSLLGGKAALTLLGAQPEDEAEYYCLLSYSGARNVFGSGTKVTVL

SEQ ID NO: 1919 - protein, 111 aa, Artificial Sequence
  V1-22_IGLJ1*01 Protein
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNHYVFGTGTKVTVL

SEQ ID NO: 1920 - protein, 116 aa, Artificial Sequence
  V4-2_IGLJ2*01 Protein
QAVLTQPSSLSASPGASASLTCTLRSGINVGTYRIYWYQQKPGSPPQYLLRYKSDSDKQQGSGVPSRFSGSKDASANAGILLISGLQSEDEADYYCMIWHSSASVVFGGGTKLTVL

SEQ ID NO: 1921 - protein, 111 aa, Artificial Sequence
  V1-22_IGLJ5*01 Protein
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNHWVFGEGTELTVL

SEQ ID NO: 1922 - protein, 111 aa, Artificial Sequence
  V1-22_IGLJ4*01 Protein
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNHFVFGGGTQLIIL

SEQ ID NO: 1923 - protein, 111 aa, Artificial Sequence
  V1-22_IGLJ2*01 Protein
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNHVVFGGGTKLTVL

SEQ ID NO: 1924 - protein, 110 aa, Artificial Sequence
  V3-3_IGLJ1*01 Protein
QAVVTQEPSLTVSPGGTVTLTCGSSTGAVTSGHYPYWFQQKPGQAPRTLIYDTSNKHSWTPARFSGSLLGGKAALTLLGAQPEDEAEYYCLLSYSGARYVFGTGTKVTVL

SEQ ID NO: 1925 - protein, 110 aa, Artificial Sequence
  V3-3_IGLJ4*01 Protein
QAVVTQEPSLTVSPGGTVTLTCGSSTGAVTSGHYPYWFQQKPGQAPRTLIYDTSNKHSWTPARFSGSLLGGKAALTLLGAQPEDEAEYYCLLSYSGARFVFGGGTQLIIL

SEQ ID NO: 1926 - protein, 110 aa, Artificial Sequence
  V3-3_IGLJ5*01 Protein
QAVVTQEPSLTVSPGGTVTLTCGSSTGAVTSGHYPYWFQQKPGQAPRTLIYDTSNKHSWTPARFSGSLLGGKAALTLLGAQPEDEAEYYCLLSYSGARWVFGEGTELTVL

SEQ ID NO: 1927 - protein, 110 aa, Artificial Sequence
  V3-3_IGLJ2*01 Protein
QAVVTQEPSLTVSPGGTVTLTCGSSTGAVTSGHYPYWFQQKPGQAPRTLIYDTSNKHSWTPARFSGSLLGGKAALTLLGAQPEDEAEYYCLLSYSGARVVFGGGTKLTVL

SEQ ID NO: 1928 - protein, 111 aa, Artificial Sequence; identical to SEQ ID NO: 1867
  V1-9_IGLJ6*01 Protein

SEQ ID NO: 1929 - protein, 111 aa, Artificial Sequence
  V1-9_IGLJ7*01 Protein
QSALTQPPFVSGAPGQSVTISCTGTSSDVGDYDHVFWYQKRLSTTSRLLIYNVNTRPSGISDLFSGSKSGNMASLTISGLKSEVEANYHCSLYSSSYTFAVFGGGTQLTVL

SEQ ID NO: 1930 - protein, 111 aa, Artificial Sequence
  V1-9_IGLJ1*01 Protein
QSALTQPPFVSGAPGQSVTISCTGTSSDVGDYDHVFWYQKRLSTTSRLLIYNVNTRPSGISDLFSGSKSGNMASLTISGLKSEVEANYHCSLYSSSYTFYVFGTGTKVTVL

SEQ ID NO: 1931 - protein, 111 aa, Artificial Sequence
  V1-9_IGLJ4*01 Protein
QSALTQPPFVSGAPGQSVTISCTGTSSDVGDYDHVFWYQKRLSTTSRLLIYNVNTRPSGISDLFSGSKSGNMASLTISGLKSEVEANYHCSLYSSSYTFFVFGGGTQLIIL

SEQ ID NO: 1932 - protein, 111 aa, Artificial Sequence
  V1-9_IGLJ5*01 Protein
QSALTQPPFVSGAPGQSVTISCTGTSSDVGDYDHVFWYQKRLSTTSRLLIYNVNTRPSGISDLFSGSKSGNMASLTISGLKSEVEANYHCSLYSSSYTFWVFGEGTELTVL

SEQ ID NO: 1933 - protein, 111 aa, Artificial Sequence
  V1-9_IGLJ2*01 Protein
QSALTQPPFVSGAPGQSVTISCTGTSSDVGDYDHVFWYQKRLSTTSRLLIYNVNTRPSGISDLFSGSKSGNMASLTISGLKSEVEANYHCSLYSSSYTFVVFGGGTKLTVL

SEQ ID NO: 1934 - protein, 118 aa, Artificial Sequence
  V4-4_IGLJ7*01 Protein
QPVLTQPSSHSASSGASVRLTCMLSSGFSVGDFWIRWYQQKPGNPPRYLLYYHSDSNKGQGSGVPSRFSGSNDASANAGILRISGLQPEDEADYYCGTWHSNSKTHAVFGGGTQLTVL

SEQ ID NO: 1935 - protein, 118 aa, Artificial Sequence
  V4-4_IGLJ6*01 Protein
QPVLTQPSSHSASSGASVRLTCMLSSGFSVGDFWIRWYQQKPGNPPRYLLYYHSDSNKGQGSGVPSRFSGSNDASANAGILRISGLQPEDEADYYCGTWHSNSKTHNVFGSGTKVTVL

SEQ ID NO: 1936 - protein, 116 aa, Artificial Sequence
  V4-1_IGLJ6*01 Protein
QPVLTQPPSSSASPGESARLTCTLPSDINVGSYNIYWYQQKPGSPPRYLLYYYSDSDKGQGSGVPSRFSGSKDASANTGILLISGLQSEDEADYYCMIWPSNASNVFGSGTKVTVL

SEQ ID NO: 1937 - protein, 116 aa, Artificial Sequence
  V4-1_IGLJ7*01 Protein
QPVLTQPPSSSASPGESARLTCTLPSDINVGSYNIYWYQQKPGSPPRYLLYYYSDSDKGQGSGVPSRFSGSKDASANTGILLISGLQSEDEADYYCMIWPSNASAVFGGGTQLTVL

SEQ ID NO: 1938 - protein, 118 aa, Artificial Sequence
  V4-4_IGLJ4*01 Protein
QPVLTQPSSHSASSGASVRLTCMLSSGFSVGDFWIRWYQQKPGNPPRYLLYYHSDSNKGQGSGVPSRFSGSNDASANAGILRISGLQPEDEADYYCGTWHSNSKTHFVFGGGTQLIIL

SEQ ID NO: 1939 - protein, 118 aa, Artificial Sequence
  V4-4_IGLJ1*01 Protein
QPVLTQPSSHSASSGASVRLTCMLSSGFSVGDFWIRWYQQKPGNPPRYLLYYHSDSNKGQGSGVPSRFSGSNDASANAGILRISGLQPEDEADYYCGTWHSNSKTHYVFGTGTKVTVL

SEQ ID NO: 1940 - protein, 116 aa, Artificial Sequence
  V4-1_IGLJ1*01 Protein
QPVLTQPPSSSASPGESARLTCTLPSDINVGSYNIYWYQQKPGSPPRYLLYYYSDSDKGQGSGVPSRFSGSKDASANTGILLISGLQSEDEADYYCMIWPSNASYVFGTGTKVTVL

SEQ ID NO: 1941 - protein, 126 aa, Artificial Sequence
  VH4-39_IGHD1-14*01_IGHJ6*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARRYNRNHDYYYYYGMDVWGQGTTVTVSS

SEQ ID NO: 1942 - protein, 130 aa, Artificial Sequence
  VH6-1_IGHD6-19*01_IGHJ6*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREGYSSGWYDYYYYYGMDVWGQGTTVTVSS

SEQ ID NO: 1943 - protein, 129 aa, Artificial Sequence
  VH4-31_IGHD3-16*01_IGHJ2*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREYYDYVWGSYAYTYWYFDLWGRGTLVTVSS

SEQ ID NO: 1944 - protein, 131 aa, Artificial Sequence
  VH4-31_IGHD2-8*01_IGHJ6*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREGYCTNGVCYTDYYYYYGMDVWGQGTTVTVSS

SEQ ID NO: 1945 - protein, 131 aa, Artificial Sequence
  VH4-61_IGHD3-9*01_IGHJ6*01 Protein
QVQLQESGPGLVKPSETLSLTCTVSGGSVSSGGYYWSWIRQPPGKGLEWIGYIYYSGSTNYNPSLKSRVTISVDTSKNQFSLKLSSVTAADTAVYYCAREYYDILTGYYNDYYYYYGMDVWGQGTTVTVSS

SEQ ID NO: 1946 - protein, 126 aa, Artificial Sequence
  VH4-31_IGHD3-22*01_IGHJ3*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREYYYDSSGYYYDAFDVWGQGTMVTVSS

SEQ ID NO: 1947 - protein, 132 aa, Artificial Sequence; identical to SEQ ID NO: 1556
  VH2-5_IGHD6-19*01_IGHJ6*01 Protein

SEQ ID NO: 1948 - protein, 120 aa, Artificial Sequence
  VH4-31_IGHD7-27*01_IGHJ2*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARANWGYWYFDLWGRGTLVTVSS

SEQ ID NO: 1949 - protein, 123 aa, Artificial Sequence
  VH4-61_IGHD6-6*01_IGHJ1*01 Protein
QVQLQESGPGLVKPSETLSLTCTVSGGSVSSGGYYWSWIRQPPGKGLEWIGYIYYSGSTNYNPSLKSRVTISVDTSKNQFSLKLSSVTAADTAVYYCAREEYSSSSAEYFQHWGQGTLVTVSS

SEQ ID NO: 1950 - protein, 123 aa, Artificial Sequence
  VH4-61_IGHD5-12*01_IGHJ4*01 Protein
QVQLQESGPGLVKPSETLSLTCTVSGGSVSSGGYYWSWIRQPPGKGLEWIGYIYYSGSTNYNPSLKSRVTISVDTSKNQFSLKLSSVTAADTAVYYCARGGYSGYDYDYFDYWGQGTLVTVSS

SEQ ID NO: 1951 - protein, 128 aa, Artificial Sequence
  VH4-61_IGHD6-19*01_IGHJ6*01 Protein
QVQLQESGPGLVKPSETLSLTCTVSGGSVSSGGYYWSWIRQPPGKGLEWIGYIYYSGSTNYNPSLKSRVTISVDTSKNQFSLKLSSVTAADTAVYYCAREGYSSGWYDYYYYYGMDVWGQGTTVTVSS

SEQ ID NO: 1952 - protein, 120 aa, Artificial Sequence
  VH4-39_IGHD7-27*01_IGHJ2*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARPNWGYWYFDLWGRGTLVTVSS

SEQ ID NO: 1953 - protein, 127 aa, Artificial Sequence
  VH4-39_IGHD3-10*01_IGHJ5*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQYYYGSGSYYNDNWFDSWGQGTLVTVSS

SEQ ID NO: 1954 - protein, 129 aa, Artificial Sequence
  VH4-39_IGHD3-16*01_IGHJ1*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQYYDYVWGSYAYTAEYFQHWGQGTLVTVSS

SEQ ID NO: 1955 - protein, 129 aa, Artificial Sequence
  VH4-39_IGHD3-16*01_IGHJ5*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQYYDYVWGSYAYTDNWFDSWGQGTLVTVSS

SEQ ID NO: 1956 - protein, 127 aa, Artificial Sequence
  VH4-31_IGHD3-10*01_IGHJ5*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREYYYGSGSYYNDNWFDSWGQGTLVTVSS

SEQ ID NO: 1957 - protein, 129 aa, Artificial Sequence
  VH4-31_IGHD3-16*01_IGHJ1*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREYYDYVWGSYAYTAEYFQHWGQGTLVTVSS

SEQ ID NO: 1958 - protein, 127 aa, Artificial Sequence
  VH4-39_IGHD3-3*01_IGHJ2*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQYYDFWSGYYTYWYFDLWGRGTLVTVSS

SEQ ID NO: 1959 - protein, 120 aa, Artificial Sequence
  VH4-4_IGHD5-5*01_IGHJ4*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCARGGYSYGYDYFDYWGQGTLVTVSS

SEQ ID NO: 1960 - protein, 120 aa, Artificial Sequence; identical to SEQ ID NO: 1959
  VH4-4_IGHD5-18*01_IGHJ4*01 Protein

SEQ ID NO: 1961 - protein, 129 aa, Artificial Sequence
  VH4-31_IGHD3-16*01_IGHJ5*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREYYDYVWGSYAYTDNWFDSWGQGTLVTVSS

SEQ ID NO: 1962 - protein, 120 aa, Artificial Sequence
  VH4-31_IGHD7-27*01_IGHJ1*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARANWGAEYFQHWGQGTLVTVSS

SEQ ID NO: 1963 - protein, 123 aa, Artificial Sequence
  VH4-39_IGHD1-26*01_IGHJ2*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARRYSGSYYYWYFDLWGRGTLVTVSS

SEQ ID NO: 1964 - protein, 127 aa, Artificial Sequence
  VH4-31_IGHD3-3*01_IGHJ2*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREYYDFWSGYYTYWYFDLWGRGTLVTVSS

SEQ ID NO: 1965 - protein, 120 aa, Artificial Sequence
  VH4-39_IGHD7-27*01_IGHJ5*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARPNWGDNWFDSWGQGTLVTVSS

SEQ ID NO: 1966 - protein, 119 aa, Artificial Sequence
  VH4-31_IGHD7-27*01_IGHJ3*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARANWGDAFDVWGQGTMVTVSS

SEQ ID NO: 1967 - protein, 120 aa, Artificial Sequence
  VH4-39_IGHD7-27*01_IGHJ1*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARPNWGAEYFQHWGQGTLVTVSS

SEQ ID NO: 1968 - protein, 124 aa, Artificial Sequence
  VH4-39_IGHD6-13*01_IGHJ2*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQGYSSSWYYWYFDLWGRGTLVTVSS

SEQ ID NO: 1969 - protein, 124 aa, Artificial Sequence
  VH4-31_IGHD6-13*01_IGHJ2*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREGYSSSWYYWYFDLWGRGTLVTVSS

SEQ ID NO: 1970 - protein, 122 aa, Artificial Sequence
  VH4-31_IGHD1-7*01_IGHJ2*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARGYNWNYYWYFDLWGRGTLVTVSS

SEQ ID NO: 1971 - protein, 122 aa, Artificial Sequence
  VH4-39_IGHD1-7*01_IGHJ2*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARRYNWNYYWYFDLWGRGTLVTVSS

SEQ ID NO: 1972 - protein, 119 aa, Artificial Sequence
  VH4-39_IGHD7-27*01_IGHJ3*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARPNWGDAFDVWGQGTMVTVSS

SEQ ID NO: 1973 - protein, 119 aa, Artificial Sequence
  VH4-31_IGHD7-27*01_IGHJ4*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARANWGDYFDYWGQGTLVTVSS

SEQ ID NO: 1974 - protein, 127 aa, Artificial Sequence
  VH1-45_IGHD3-16*01_IGHJ4*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARYYYDYVWGSYAYTDYFDYWGQGTLVTVSS

SEQ ID NO: 1975 - protein, 125 aa, Artificial Sequence
  VH4-4_IGHD2-2*01_IGHJ5*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCAREGYCSSTSCYADNWFDSWGQGTLVTVSS

SEQ ID NO: 1976 - protein, 124 aa, Artificial Sequence
  VH4-59_IGHD3-22*01_IGHJ3*01 Protein
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAREYYYDSSGYYYDAFDVWGQGTMVTVSS

SEQ ID NO: 1977 - protein, 126 aa, Artificial Sequence
  VH4-28_IGHD2-8*01_IGHJ5*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARKGYCTNGVCYTDNWFDSWGQGTLVTVSS

SEQ ID NO: 1978 - protein, 127 aa, Artificial Sequence
  VH1-69_IGHD6-19*01_IGHJ6*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREGYSSGWYDYYYYYGMDVWGQGTTVTVSS

SEQ ID NO: 1979 - protein, 128 aa, Artificial Sequence
  VH2-5_IGHD7-27*01_IGHJ3*01 Protein
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRGYSSGWYDYYYYYGMDVWGQGTTVTVSS

SEQ ID NO: 1980 - protein, 123 aa, Artificial Sequence
  VH4-61_IGHD1-26*01_IGHJ5*01 Protein
QVQLQESGPGLVKPSETLSLTCTVSGGSVSSGGYYWSWIRQPPGKGLEWIGYIYYSGSTNYNPSLKSRVTISVDTSKNQFSLKLSSVTAADTAVYYCARGYSGSYYDNWFDSWGQGTLVTVSS

SEQ ID NO: 1981 - protein, 125 aa, Artificial Sequence
  VH6-1_IGHD6-6*01_IGHJ2*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREEYSSSSYWYFDLWGRGTLVTVSS

SEQ ID NO: 1982 - protein, 128 aa, Artificial Sequence
  VH2-70_IGHD3-22*01_IGHJ5*01 Protein
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIRYYYDSSGYYYDNWFDSWGQGTLVTVSS

SEQ ID NO: 1983 - protein, 119 aa, Artificial Sequence
  VH4-4_IGHD1-1*01_IGHJ4*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCARGYNWNDDYFDYWGQGTLVTVSS

SEQ ID NO: 1984 - protein, 119 aa, Artificial Sequence; identical to SEQ ID NO: 1983
  VH4-4_IGHD1-20*01_IGHJ4*01 Protein

SEQ ID NO: 1985 - protein, 125 aa, Artificial Sequence
  VH6-1_IGHD5-18*01_IGHJ2*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGGYSYGYYWYFDLWGRGTLVTVSS

SEQ ID NO: 1986 - protein, 125 aa, Artificial Sequence; identical to SEQ ID NO: 1985
  VH6-1_IGHD5-5*01_IGHJ2*01 Protein

SEQ ID NO: 1987 - protein, 118 aa, Artificial Sequence
  VH4-59_IGHD7-27*01_IGHJ2*01 Protein
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARANWGYWYFDLWGRGTLVTVSS

SEQ ID NO: 1988 - protein, 121 aa, Artificial Sequence
  VH4-4_IGHD4-23*01_IGHJ1*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCARDDYGGNSAEYFQHWGQGTLVTVSS

SEQ ID NO: 1989 - protein, 129 aa, Artificial Sequence
  VH6-1_IGHD3-3*01_IGHJ1*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREYYDFWSGYYTAEYFQHWGQGTLVTVSS

SEQ ID NO: 1990 - protein, 124 aa, Artificial Sequence
  VH6-1_IGHD1-1*01_IGHJ2*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGYNWNDYWYFDLWGRGTLVTVSS

SEQ ID NO: 1991 - protein, 124 aa, Artificial Sequence; identical to SEQ ID NO: 1990
  VH6-1_IGHD1-20*01_IGHJ2*01 Protein

SEQ ID NO: 1992 - protein, 125 aa, Artificial Sequence
  VH4-28_IGHD2-15*01_IGHJ3*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARKGYCSGGSCYSDAFDVWGQGTMVTVSS

SEQ ID NO: 1993 - protein, 130 aa, Artificial Sequence
  VH6-1_IGHD3-16*01_IGHJ3*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREYYDYVWGSYAYTDAFDVWGQGTMVTVSS

SEQ ID NO: 1994 - protein, 124 aa, Artificial Sequence
  VH4-61_IGHD6-19*01_IGHJ2*01 Protein
QVQLQESGPGLVKPSETLSLTCTVSGGSVSSGGYYWSWIRQPPGKGLEWIGYIYYSGSTNYNPSLKSRVTISVDTSKNQFSLKLSSVTAADTAVYYCAREGYSSGWYYWYFDLWGRGTLVTVSS

SEQ ID NO: 1995 - protein, 124 aa, Artificial Sequence
  VH4-28_IGHD2-21*01_IGHJ3*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARKAYCGGDCYSDAFDVWGQGTMVTVSS

SEQ ID NO: 1996 - protein, 6 aa, Artificial Sequence
  Linker Sequence (SSSSG)n
  VARIANT (6)...(6): Xaa - repeat of AA 1-5, N numbers of time
SSSSGX

SEQ ID NO: 1997 - DNA, 3522 bp, Artificial Sequence
  Plasmid pGL4.70
ggcctaactggccggtacctgagctcgctagcctcgaggatatcaagatctggcctcggcggccaagcttggcaatccggtactgttggtaaagccaccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagtaattctagagtcggggcggccggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataaggatccgtcgaccgatgcccttgagagccttcaacccagtcagctccttccggtgggcgcggggcatgactatcgtcgccgcacttatgactgtcttctttatcatgcaactcgtaggacaggtgccggcagcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagcggccgcaaatgctaaaccactgcagtggttaccagtgcttgatcagtgaggcaccgatctcagcgatctgcctatttcgttcgtccatagtggcctgactccccgtcgtgtagatcactacgattcgtgagggcttaccatcaggccccagcgcagcaatgatgccgcgagagccgcgttcaccggcccccgatttgtcagcaatgaaccagccagcagggagggccgagcgaagaagtggtcctgctactttgtccgcctccatccagtctatgagctgctgtcgtgatgctagagtaagaagttcgccagtgagtagtttccgaagagttgtggccattgctactggcatcgtggtatcacgctcgtcgttcggtatggcttcgttcaactctggttcccagcggtcaagccgggtcacatgatcacccatattatgaagaaatgcagtcagctccttagggcctccgatcgttgtcagaagtaagttggccgcggtgttgtcgctcatggtaatggcagcactacacaattctcttaccgtcatgccatccgtaagatgcttttccgtgaccggcgagtactcaaccaagtcgttttgtgagtagtgtatacggcgaccaagctgctcttgcccggcgtctatacgggacaacaccgcgccacatagcagtactttgaaagtgctcatcatcgggaatcgttcttcggggcggaaagactcaaggatcttgccgctattgagatccagttcgatatagcccactcttgcacccagttgatcttcagcatcttttactttcaccagcgtttcggggtgtgcaaaaacaggcaagcaaaatgccgcaaagaagggaatgagtgcgacacgaaaatgttggatgctcatactcgtcctttttcaatattattgaagcatttatcagggttactagtacgtctctcaaggataagtaagtaatattaaggtacgggaggtattggacaggccgcaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctct

SEQ ID NO: 1998 - DNA, 4283 bp, Artificial Sequence
  Plasmid pGL4.23
ggcctaactggccggtacctgagctcgctagcctcgaggatatcaagatctggcctcggcggccaagcttagacactagagggtatataatggaagctcgacttccagcttggcaatccggtactgttggtaaagccaccatggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtgtaataattctagagtcggggcggccggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataaggatccgtcgaccgatgcccttgagagccttcaacccagtcagctccttccggtgggcgcggggcatgactatcgtcgccgcacttatgactgtcttctttatcatgcaactcgtaggacaggtgccggcagcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagcggccgcaaatgctaaaccactgcagtggttaccagtgcttgatcagtgaggcaccgatctcagcgatctgcctatttcgttcgtccatagtggcctgactccccgtcgtgtagatcactacgattcgtgagggcttaccatcaggccccagcgcagcaatgatgccgcgagagccgcgttcaccggcccccgatttgtcagcaatgaaccagccagcagggagggccgagcgaagaagtggtcctgctactttgtccgcctccatccagtctatgagctgctgtcgtgatgctagagtaagaagttcgccagtgagtagtttccgaagagttgtggccattgctactggcatcgtggtatcacgctcgtcgttcggtatggcttcgttcaactctggttcccagcggtcaagccgggtcacatgatcacccatattatgaagaaatgcagtcagctccttagggcctccgatcgttgtcagaagtaagttggccgcggtgttgtcgctcatggtaatggcagcactacacaattctcttaccgtcatgccatccgtaagatgcttttccgtgaccggcgagtactcaaccaagtcgttttgtgagtagtgtatacggcgaccaagctgctcttgcccggcgtctatacgggacaacaccgcgccacatagcagtactttgaaagtgctcatcatcgggaatcgttcttcggggcggaaagactcaaggatcttgccgctattgagatccagttcgatatagcccactcttgcacccagttgatcttcagcatcttttactttcaccagcgtttcggggtgtgcaaaaacaggcaagcaaaatgccgcaaagaagggaatgagtgcgacacgaaaatgttggatgctcatactcgtcctttttcaatattattgaagcatttatcagggttactagtacgtctctcaaggataagtaagtaatattaaggtacgggaggtattggacaggccgcaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctct

SEQ ID NO: 1999 - protein, 1255 aa, Homo sapiens [sequence omitted]

SEQ ID NO: 2000 - protein, 1150 aa, Homo sapiens
  EGFR
VLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 2001 - protein, 1390 aa, Homo sapiens [sequence omitted]

SEQ ID NO: 2002 - protein, 2555 aa, Homo sapiens
  Notch-1
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 2003 - protein, 2471 aa, Homo sapiens
  Notch-2
MPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 2004 - protein, 2321 aa, Homo sapiens
  Notch-3
MGPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPVAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 2005 - protein, 2003 aa, Homo sapiens
  Notch-4
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 2006 - protein, 742 aa, Homo sapiens [sequence omitted]

SEQ ID NO: 2007 - protein, 1367 aa, Homo sapiens
  IGF-1R
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 2008 - protein, 829 aa, Homo sapiens
  p-cadherin
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD

SEQ ID NO: 2009 - protein, 508 aa, Homo sapiens
  EPO-R
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 2010 - protein, 685 aa, Homo sapiens
  DLL4
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAICSPRDSMYQSVCLISEERNECVIATEV

SEQ ID NO: 2011 - protein, 297 aa, Homo sapiens
  CD20
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 2012 - protein, 232 aa, Homo sapiens
  VEGFA
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 2013 - protein, 61 aa, Homo sapiens
  CD52
MKRFLFLLLTISLLVMVQIQTGLSGQNDTSQTSSPSASSNISGGIFLFFVANAIIHLFCFS

SEQ ID NO: 2014 - protein, 233 aa, Homo sapiens
  TNF-alpha
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 2015 - protein, 272 aa, Homo sapiens
  CD25
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 2016 - protein, 171 aa, Homo sapiens
  CD3 delta chain
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 2017 - protein, 182 aa, Homo sapiens
  CD3 gamma chain
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 2018 - protein, 164 aa, Homo sapiens
  CD3 zeta chain
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 2019 - protein, 207 aa, Homo sapiens
  CD3 epsilon chain
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 2020 - protein, 428 aa, Homo sapiens
  IgE constant region
ASTQSPSVFPLTRCCKNIPSNATSVTLGCLATGYFPEPVMVTWDTGSLNGTTMTLPATTLTLSGHYATISLLTVSGAWAKQMFTCRVAHTPSSTDWVDNKTFSVCSRDFTPPTVKILQSSCDGGGHFPPTIQLLCLVSGYTPGTINITWLEDGQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 2021 - protein, 257 aa, Homo sapiens
  IgE Fc receptor subunit alpha FcER1
MAPAMESPTLLCVALLFFAPDGVLAVPQKPKVSLNPPWNRIFKGENVTLTCNGNNFFEVSSTKWFHNGSLSEETNSSLNIVNAKFEDSGEYKCQHQQVNESEPVYLEVFSDWLLLQASAEVVMEGQPLFLRCHGWRNWDVYKVIYYKDGEALKYWYENHNISITNATVEDSGTYYCTGKVWQLDYESEPLNITVIKAPREKYWLQFFIPLLVVILFAVDTGLFISTQQQVTFLLKIKRTRKGFRLLNPHPKPNPKNN

SEQ ID NO: 2022 - protein, 321 aa, Homo sapiens
  IgE RcERII
MEEGQYSEIEELPRRRCCRRGTQIVLLGLVTAALWAGLLTLLLLWHWDTTQSLKQLEERAARNVSQVSKNLESHHGDQMAQKSQSTQISQELEELRAEQQRLKSQDLELSWNLNGLQADLSSFKSQELNERNEASDLLERLREEVTKLRMELQVSSGFVCNTCPEKWINFQRKCYYFGKGTKQWVHARYACDDMEGQLVSIHSPEEQDFLTKHASHTGSWIGLRNLDLKGEFIWVDGSHVDYSNWAPGEPTSRSQGEDCVMMRGSGRWNDAFCDRKLGAWVCDRLATCTPPASEGSAESMGPDSRPDPDGRLPTPSAPLHS

SEQ ID NO: 2023 - protein, 788 aa, Homo sapiens
  IIIa integrin receptor
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 2024 - protein, 1039 aa, Homo sapiens
  IIb integrin receptor
MARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRAEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEERAIPIWWVLVGVLGGLLLLTILVLAMWKVGFFKRNRPPLEEDDEEGE

SEQ ID NO: 2025 - protein, 836 aa, Homo sapiens
  G-CSF-R
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 2026 - protein, 400 aa, Homo sapiens
  CM-CSF-R
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDGNLGSVYIYVLLIVGTLVCGIVLGFLFKRFLRIQRLFPPVPQIKDKLNDNHEVEDEIIWEEFTPEEGKGYREEVLTVKEIT

SEQ ID NO: 2027 - protein, 116 aa, Artificial Sequence; identical to SEQ ID NO: 1920
  gnl|Fabrus|V4-2_IGLJ2*01

SEQ ID NO: 2028 - protein, 125 aa, Artificial Sequence
  gnl|Fabrus|VH1-2_IGHD2-21*01_IGHJ1*01
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAREAYCGGDCYSAEYFQHWGQGTLVTVSS

SEQ ID NO: 2029 - protein, 31 aa, Homo sapiens
  DLL4 epitope
  CHAIN (1)...(31): Amino acids 252-282 of DLL4
ECIPHNGCRHGTCSTPWQCTCDEGWGGLFCD

SEQ ID NO: 2030 - protein, 30 aa, Hom osapiens
  EpoR epitope
  CHAIN (1)...(30): Amino acids 49-78 of EpoR
PGNYSFSYQLEDEPWKLCRLHQAPTARGAV

SEQ ID NO: 2031 - protein, 32 aa, Homo sapiens
  ErbB2 epitope
  CHAIN (1)...(32): Amino acids 22-53 of ErbB2
STQVCTGTDMKLRLPASPETHLDMLRHLYQGC

SEQ ID NO: 2032 - protein, 65 aa, Homo sapiens
  ErbB2 epitope
  CHAIN (1)...(65): Amino acids 561-625 of ErbB2
LPCHPECQPQNGSVTCFGPEADQCVACAHYKDPPFCVARCPSGVKPDLSYMPIWKFPDEEGACQP

SEQ ID NO: 2033 - protein, 59 aa, Homo sapiens
  ErbB2 epitope
  CHAIN (1)...(59): Amino acids 541-599 of ErbB2
VEECRVLQGLPREYVNARHCLPCHPECQPQNGSVTCFGPEADQCVACAHYKDPPFCVAR

SEQ ID NO: 2034 - protein, 20 aa, Artificial Sequence
  Her2/Neu epitope
  CHAIN (1)...(20): Amino acids 557-561, 570-573 and 593-603 of mature Her2/Neu
PEADQDPPFKFPDEEGACQP

SEQ ID NO: 2035 - protein, 15 aa, Artificial Sequence
  Her2/Neu epitope
  CHAIN (1)...(15): Amino acids 156, 245, 252, 257, 268, 285-290, 294-296 and 311 of mature Her2/Neu
QHYFTDVGSCTPLHK

SEQ ID NO: 2036 - protein, 15 aa, Artificial Sequence
  EGFR epitope
  CHAIN (1)...(15): Amino acids 353, 384, 408-409, 412, 417-418, 438, 440, 443, 465-468 and 473 of mature EGFR
RQQHFVSISKKIISN

SEQ ID NO: 2037 - protein, 9 aa, Artificial Sequence
  EGFR epitope
  CHAIN (1)...(2): Amino acids 293-294 of EGFR
  CHAIN (4)...(9): Amino acids 298-303 of EGFR
KKGNYVVTD

SEQ ID NO: 2038 - protein, 19 aa, Artificial Sequence
  VEGFA epitope
  CHAIN (1)...(19): Amino acids 17, 21, 45, 48, 79-84 and 86-94 of mature VEGFA
FYYKQIMRIKHQGQHIGEM

SEQ ID NO: 2039 - protein, 19 aa, Artificial Sequence
  VEGFA epitope
  CHAIN (1)...(19): Amino acids 17-18, 21-22, 25, 63-64, 66, 104, 106, 48, 81, 83 and 86-94 of mature VEGFA
FMYQYDELCPKMIHQGQHI

SEQ ID NO: 2040 - protein, 25 aa, Artificial Sequence
  VEGFA epitope
KFMDYQRYCHCNDLNKECEKQMIQI

SEQ ID NO: 2041 - protein, 19 aa, Artificial Sequence
  VEGFA epitope
  CHAIN (1)...(19): Amino acids 71, 74, 105-110, 112-120, 43 and 47 of VEGFA
YKQIMRIKHQGQHIGEMFY

SEQ ID NO: 2042 - protein, 19 aa, Artificial Sequence
  VEGFA epitope
  CHAIN (1)...(19): Amino acids 43, 47, 71, 74, 105-110 and 112-120 of VEGFA
FYYKQIMRIKHQGQHIGEM

SEQ ID NO: 2043 - protein, 8 aa, Artificial Sequence
  CD52 epitope
  CHAIN (2)...(7): Amino acids 32-37 of CD52
GTSSPSAD

SEQ ID NO: 2044 - protein, 8 aa, Homo sapiens
  CD20 epitope
  CHAIN (1)...(8): Amino acids 168-175 of CD20
EPANPSEK

SEQ ID NO: 2045 - protein, 10 aa, Artificial Sequence
  CD20 epitope
  CHAIN (1)...(10): Amino acids 164 and 166-174 of CD20
INCEPANPSE

SEQ ID NO: 2046 - protein, 10 aa, Artificial Sequence
  CD20 epitope
  CHAIN (1)...(10): Amino acids 164-172 and 175 of CD20
IYNCEPANPK

SEQ ID NO: 2047 - protein, 17 aa, Artificial Sequence
  CD40 epitope
  CHAIN (1)...(17): Amino acids 129-132, 142-146, 178, 218 and 245-250 of CD40
EASSEKGYYCCSQVSHG

SEQ ID NO: 2048 - protein, 13 aa, Artificial Sequence
  CD41 (GPIIb) epitope
  CHAIN (1)...(13): Amino acids 77-82, 149, 158, 206, 208 and 213-215 of CD41
RNVGSQNNSRLWH

SEQ ID NO: 2049 - protein, 20 aa, Artificial Sequence
  TPO
  CHAIN (1)...(20): Amino acids 57-61, 98 and 102-115 of TPO
ETKAQRGALQSLLGTQLPPQ

SEQ ID NO: 2050 - DNA, 389 bp, Artificial Sequence
  VH3-23R
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagacctactatggttcggggagttattataacgactactttggtctctggggccaaggaaccctggtcaccgtctcctcagctagc

SEQ ID NO: 2051 - DNA, 4963 bp, Artificial Sequence
  pF-VH3-23R
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaaaaagaatatcgcatttcttcttgcatctatgttcgttttttcaattgctacgaacgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagacctactatggttcggggagttattataacgactactttggtctctggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcacctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 2052 - DNA, 54 bp, Artificial Sequence
  J1-Forward
cgaaagagacctactatggttcgggtctctcctacgctgaatacttccagcact

SEQ ID NO: 2053 - DNA, 54 bp, Artificial Sequence
  J1-Reverse
ccccagtgctggaagtattcagcgtaggagagacccgaaccatagtaggtctct

SEQ ID NO: 2054 - DNA, 54 bp, Artificial Sequence
  J2-Forward
cgaaagagacctactatggttcgggtctctcctactactggtacttcgattcct

SEQ ID NO: 2055 - DNA, 54 bp, Artificial Sequence
  J2-Reverse
ccccaggaatcgaagtaccagtagtaggagagacccgaaccatagtaggtctct

SEQ ID NO: 2056 - DNA, 48 bp, Artificial Sequence
  J3-Forward
cgaaagagacctactatggttcgggtctctcctatgcttttgatgtct

SEQ ID NO: 2057 - DNA, 48 bp, Artificial Sequence
  J3-Reverse
ccccagacatcaaaagcataggagagacccgaaccatagtaggtctct

SEQ ID NO: 2058 - DNA, 48 bp, Artificial Sequence
  J4-Forward
cgaaagagacctactatggttcgggtctctcctactactttgactact

SEQ ID NO: 2059 - DNA, 48 bp, Artificial Sequence
  J4-Reverse
ccccagtagtcaaagtagtaggagagacccgaaccatagtaggtctct

SEQ ID NO: 2060 - DNA, 51 bp, Artificial Sequence
  J5-Forward
cgaaagagacctactatggttcgggtctctcctacaactggttcgactact

SEQ ID NO: 2061 - DNA, 51 bp, Artificial Sequence
  J5-Reverse
ccccaggagtcgaaccagttgtaggagagacccgaaccatagtaggtctct

SEQ ID NO: 2062 - DNA, 63 bp, Artificial Sequence
  J6-Forward
cgaaagagacctactatggttcgggtctctcctattactactactactacggtatggacgtct

SEQ ID NO: 2063 - DNA, 63 bp, Artificial Sequence
  J6-Reverse
ccccagacgtccataccgtagtagtagtagtaataggagagacccgaaccatagtaggtctct

SEQ ID NO: 2064 - DNA, 4963 bp, Artificial Sequence
  pF-VH3-23R-IGHJ1
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaaaaagaatatcgcatttcttcttgcatctatgttcgttttttcaattgctacgaacgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagacctactatggttcgggtctctcctacgctgaatacttccagcactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcacctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 2065 - DNA, 4963 bp, Artificial Sequence
  pF-VH3-23R-IGHJ2
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaaaaagaatatcgcatttcttcttgcatctatgttcgttttttcaattgctacgaacgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagacctactatggttcgggtctctcctactactggtacttcgattcctggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcacctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 2066 - DNA, 4957 bp, Artificial Sequence
  pF-VH3-23R-IGHJ3
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaaaaagaatatcgcatttcttcttgcatctatgttcgttttttcaattgctacgaacgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagacctactatggttcgggtctctcctatgcttttgatgtctggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcacctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 2067 - DNA, 4957 bp, Artificial Sequence
  pF-VH3-23R-IGHJ4
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaaaaagaatatcgcatttcttcttgcatctatgttcgttttttcaattgctacgaacgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagacctactatggttcgggtctctcctactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcacctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 2068 - DNA, 4960 bp, Artificial Sequence
  pF-VH3-23R-IGHJ5
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaaaaagaatatcgcatttcttcttgcatctatgttcgttttttcaattgctacgaacgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagacctactatggttcgggtctctcctacaactggttcgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcacctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 2069 - DNA, 4972 bp, Artificial Sequence
  pF-VH3-23R-IGHJ6
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaaaaagaatatcgcatttcttcttgcatctatgttcgttttttcaattgctacgaacgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagacctactatggttcgggtctctcctattactactactactacggtatggacgtctggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcacctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 2070 - DNA, 383 bp, Artificial Sequence
  gi|Fabrus|A01_VH3-23_IGHD1-1*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtacaactggaacgacgtcctacgctgaatacttccagcactggggccaaggaaccctggtcaccgtctcctcagctagc

SEQ ID NO: 2071 - DNA, 383 bp, Artificial Sequence
  gi|Fabrus|A02_VH3-23_IGHD1-1*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtacaactggaacgacggtcctacgctgaatacttccagcactggggccaaggaaccctggtcaccgtctcctcagctagc

SEQ ID NO: 2072 - DNA, 383 bp, Artificial Sequence
  gi|Fabrus|A03_VH3-23_IGHD1-1*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtacaactggaacgactcctacgctgaatacttccagcactggggccaaggaaccctggtcaccgtctcctcagctagc

SEQ ID NO: 2073 - DNA, 383 bp, Artificial Sequence
  gi|Fabrus|A04_VH3-23_IGHD1-7*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaactacgtcctacgctgaatacttccagcactggggccaaggaaccctggtcaccgtctcctcagctagc

SEQ ID NO: 2074 - DNA, 383 bp, Artificial Sequence
  gi|Fabrus|A05_VH3-23_IGHD1-7*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaactactcctacgctgaatacttccagcactggggccaaggaaccctggtcaccgtctcctcagctagc

SEQ ID NO: 2075 - DNA, 383 bp, Artificial Sequence
  gi|Fabrus|A06_VH3-23_IGHD1-14*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataaccggaaccacgtcctacgctgaatacttccagcactggggccaaggaaccctggtcaccgtctcctcagctagc

SEQ ID NO: 2076 - DNA, 383 bp, Artificial Sequence
  gi|Fabrus|A07_VH3-23_IGHD1-14*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataaccggaaccactcctacgctgaatacttccagcactggggccaaggaaccctggtcaccgtctcctcagctagc

SEQ ID NO: 2077 - DNA, 383 bp, Artificial Sequence
  gi|Fabrus|A08_VH3-23_IGHD1-20*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaacgacgtcctacgctgaatacttccagcactggggccaaggaaccctggtcaccgtctcctcagctagc

SEQ ID NO: 2078 - DNA, 383 bp, Artificial Sequence
  gi|Fabrus|A09_VH3-23_IGHD1-20*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaacgactcctacgctgaatacttccagcactggggccaaggaaccctggtcaccgtctcctcagctagc

SEQ ID NO: 2079 - DNA, 386 bp, Artificial Sequence
  gi|Fabrus|A10_VH3-23_IGHD1-26*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagtgggagctactacgtcctacgctgaatacttccagcactggggccaaggaaccctggtcaccgtctcctcagctagc

SEQ ID NO: 2080 - DNA, 386 bp, Artificial Sequence
  gi|Fabrus|A11_VH3-23_IGHD1-26*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagtgggagctactactcctacgctgaatacttccagcactggggccaaggaaccctggtcaccgtctcctcagctagc

SEQ ID NO: 2081 - DNA, 395 bp, Artificial Sequence
  gi|Fabrus|A12_VH3-23_IGHD2-2*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtagtaccagctgctatgcctcctacgctgaatacttccagcactggggccaaggaaccctggtcaccgtctcctcagctagc

SEQ ID NO: 2082 - DNA, 395 bp, Artificial Sequence
  gi|Fabrus|B01_VH3-23_IGHD2-2*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtagtaccagctgctatgtcctacgctgaatacttccagcactggggccaaggaaccctggtcaccgtctcctcagctagc

SEQ ID NO: 2083 - DNA, 395 bp, Artificial Sequence
  gi|Fabrus|B02_VH3-23_IGHD2-8*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtactaatggtgtatgctatacctcctacgctgaatacttccagcactggggccaaggaaccctggtcaccgtctcctcagctagc

SEQ ID NO: 2084 - DNA, 395 bp, Artificial Sequence
  i|Fabrus|B03_VH3-23_IGHD2-8*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtactaatggtgtatgctatatcctacgctgaatacttccagcactggggccaaggaaccctggtcaccgtctcctcagctagc

SEQ ID NO: 2085 - DNA, 395 bp, Artificial Sequence
  gi|Fabrus|B04_VH3-23_IGHD2-15*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtggtggtagctgctactcctcctacgctgaatacttccagcactggggccaaggaaccctggtcaccgtctcctcagctagc

SEQ ID NO: 2086 - DNA, 395 bp, Artificial Sequence
  gi|Fabrus|B05_VH3-23_IGHD2-15*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtggtggtagctgctacttcctacgctgaatacttccagcactggggccaaggaaccctggtcaccgtctcctcagctagc

SEQ ID NO: 2087 - DNA, 392 bp, Artificial Sequence
  gi|Fabrus|B06_VH3-23_IGHD2-21*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagcatattgtggtggtgattgctattcctcctacgctgaatacttccagcactggggccaaggaaccctggtcaccgtctcctcagctagc

SEQ ID NO: 2088 - DNA, 392 bp, Artificial Sequence
  gi|Fabrus|B07_VH3-23_IGHD2-21*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagcatattgtggtggtgattgctatttcctacgctgaatacttccagcactggggccaaggaaccctggtcaccgtctcctcagctagc

SEQ ID NO: 2089 - DNA, 395 bp, Artificial Sequence
  gi|Fabrus|B08_VH3-23_IGHD3-3*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtattacgatttttggagtggttattatactcctacgctgaatacttccagcactggggccaaggaaccctggtcaccgtctcctcagctagc

SEQ ID NO: 2090 - DNA, 395 bp, Artificial Sequence
  gi|Fabrus|B09_VH3-23_IGHD3-3*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatttttggagtggttattatacctcctacgctgaatacttccagcactggggccaaggaaccctggtcaccgtctcctcagctagc

SEQ ID NO: 2091 - DNA, 395 bp, Artificial Sequence
  gi|Fabrus|B10_VH3-23_IGHD3-3*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattacgatttttggagtggttattatatcctacgctgaatacttccagcactggggccaaggaaccctggtcaccgtctcctcagctagc

SEQ ID NO: 2092 - DNA, 395 bp, Artificial Sequence
  gi|Fabrus|B11_VH3-23_IGHD3-9*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatattttgactggttattataactcctacgctgaatacttccagcactggggccaaggaaccctggtcaccgtctcctcagctagc

SEQ ID NO: 2093 - DNA, 395 bp, Artificial Sequence
  gi|Fabrus|B12_VH3-23_IGHD3-10*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatggttcggggagttattataactcctacgctgaatacttccagcactggggccaaggaaccctggtcaccgtctcctcagctagc

SEQ ID NO: 2094 - DNA, 395 bp, Artificial Sequence
  gi|Fabrus|C01_VH3-23_IGHD3-10*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatggttcggggagttattatatcctacgctgaatacttccagcactggggccaaggaaccctggtcaccgtctcctcagctagc

SEQ ID NO: 2095 - DNA, 401 bp, Artificial Sequence
  gi|Fabrus|C02_VH3-23_IGHD3-16*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattatgattacgtttgggggagttatgcttatacctcctacgctgaatacttccagcactggggccaaggaaccctggtcaccgtctcctcagctagc

SEQ ID NO: 2096 - DNA, 401 bp, Artificial Sequence
  gi|Fabrus|C03_VH3-23_IGHD3-16*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattatgattacgtttgggggagttatgcttatatcctacgctgaatacttccagcactggggccaaggaaccctggtcaccgtctcctcagctagc

SEQ ID NO: 2097 - DNA, 395 bp, Artificial Sequence
  gi|Fabrus|C04_VH3-23_IGHD3-22*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatgatagtagtggttattactactcctacgctgaatacttccagcactggggccaaggaaccctggtcaccgtctcctcagctagc

SEQ ID NO: 2098 - DNA, 395 bp, Artificial Sequence
  gi|Fabrus|C05_VH3-23_IGHD3-22*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatgatagtagtggttattacttcctacgctgaatacttccagcactggggccaaggaaccctggtcaccgtctcctcagctagc

SEQ ID NO: 2099 - DNA, 380 bp, Artificial Sequence
  gi|Fabrus|C06_VH3-23_IGHD4-4*01(1)>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacagtaactactcctacgctgaatacttccagcactggggccaaggaaccctggtcaccgtctcctcagctagc

SEQ ID NO: 2100 - DNA, 380 bp, Artificial Sequence
  gi|Fabrus|C07_VH3-23_IGHD4-4*01(1)>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacagtaacttcctacgctgaatacttccagcactggggccaaggaaccctggtcaccgtctcctcagctagc

SEQ ID NO: 2101 - DNA, 380 bp, Artificial Sequence; identical to SEQ ID NO: 2099
  gi|Fabrus|C08_VH3-23_IGHD4-11*01(1)>2_IGHJ1*01

SEQ ID NO: 2102 - DNA, 380 bp, Artificial Sequence; identical to SEQ ID NO: 2100
  gi|Fabrus|C09_VH3-23_IGHD4-11*01(1)>3_IGHJ1*01

SEQ ID NO: 2103 - DNA, 380 bp, Artificial Sequence
  gi|Fabrus|C10_VH3-23_IGHD4-17*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtgactactcctacgctgaatacttccagcactggggccaaggaaccctggtcaccgtctcctcagctagc

SEQ ID NO: 2104 - DNA, 380 bp, Artificial Sequence
  gi|Fabrus|C11_VH3-23_IGHD4-17*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtgacttcctacgctgaatacttccagcactggggccaaggaaccctggtcaccgtctcctcagctagc

SEQ ID NO: 2105 - DNA, 383 bp, Artificial Sequence
  gi|Fabrus|C12_VH3-23_IGHD4-23*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtggtaactcctcctacgctgaatacttccagcactggggccaaggaaccctggtcaccgtctcctcagctagc

SEQ ID NO: 2106 - DNA, 383 bp, Artificial Sequence
  gi|Fabrus|D01_VH3-23_IGHD4-23*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtggtaacttcctacgctgaatacttccagcactggggccaaggaaccctggtcaccgtctcctcagctagc

SEQ ID NO: 2107 - DNA, 386 bp, Artificial Sequence
  gi|Fabrus|D02_VH3-23_IGHD5-5*01(2)>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatacagctatggttacgtcctacgctgaatacttccagcactggggccaaggaaccctggtcaccgtctcctcagctagc

SEQ ID NO: 2108 - DNA, 386 bp, Artificial Sequence
  gi|Fabrus|D03_VH3-23_IGHD5-5*01(2)>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggatacagctatggttacggtcctacgctgaatacttccagcactggggccaaggaaccctggtcaccgtctcctcagctagc

SEQ ID NO: 2109 - DNA, 386 bp, Artificial Sequence
  gi|Fabrus|D04_VH3-23_IGHD5-5*01(2)>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatacagctatggttactcctacgctgaatacttccagcactggggccaaggaaccctggtcaccgtctcctcagctagc

SEQ ID NO: 2110 - DNA, 389 bp, Artificial Sequence
  gi|Fabrus|D05_VH3-23_IGHD5-12*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatatagtggctacgattacgtcctacgctgaatacttccagcactggggccaaggaaccctggtcaccgtctcctcagctagc

SEQ ID NO: 2111 - DNA, 389 bp, Artificial Sequence
  gi|Fabrus|D06_VH3-23_IGHD5-12*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatatagtggctacgattactcctacgctgaatacttccagcactggggccaaggaaccctggtcaccgtctcctcagctagc

SEQ ID NO: 2112 - DNA, 386 bp, Artificial Sequence; identical to SEQ ID NO: 2107
  gi|Fabrus|D07_VH3-23_IGHD5-18*01(2)>1_IGHJ1*01

SEQ ID NO: 2113 - DNA, 386 bp, Artificial Sequence; identical to SEQ ID NO: 2108
  gi|Fabrus|D08_VH3-23_IGHD5-18*01(2)>2_IGHJ1*01

SEQ ID NO: 2114 - DNA, 386 bp, Artificial Sequence; identical to SEQ ID NO: 2109
  gi|Fabrus|D09_VH3-23_IGHD5-18*01(2)>3_IGHJ1*01

SEQ ID NO: 2115 - DNA, 386 bp, Artificial Sequence
  gi|Fabrus|D10_VH3-23_IGHD5-24*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagagatggctacaattacgtcctacgctgaatacttccagcactggggccaaggaaccctggtcaccgtctcctcagctagc

SEQ ID NO: 2116 - DNA, 386 bp, Artificial Sequence
  gi|Fabrus|D11_VH3-23_IGHD5-24*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagagatggctacaattactcctacgctgaatacttccagcactggggccaaggaaccctggtcaccgtctcctcagctagc

SEQ ID NO: 2117 - DNA, 383 bp, Artificial Sequence
  gi|Fabrus|D12_VH3-23_IGHD6-6*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagtatagcagctcgtcctcctacgctgaatacttccagcactggggccaaggaaccctggtcaccgtctcctcagctagc

SEQ ID NO: 2118 - DNA, 383 bp, Artificial Sequence
  gi|Fabrus|E01_VH3-23_IGHD6-6*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaagtatagcagctcgtccgtcctacgctgaatacttccagcactggggccaaggaaccctggtcaccgtctcctcagctagc

SEQ ID NO: 2119 - DNA, 386 bp, Artificial Sequence
  gi|Fabrus|E02_VH3-23_IGHD6-13*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcagctggtactcctacgctgaatacttccagcactggggccaaggaaccctggtcaccgtctcctcagctagc

SEQ ID NO: 2120 - DNA, 386 bp, Artificial Sequence
  gi|Fabrus|E03_VH3-23_IGHD6-13*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcagctggtacgtcctacgctgaatacttccagcactggggccaaggaaccctggtcaccgtctcctcagctagc

SEQ ID NO: 2121 - DNA, 386 bp, Artificial Sequence
  gi|Fabrus|E04_VH3-23_IGHD6-19*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagtggctggtactcctacgctgaatacttccagcactggggccaaggaaccctggtcaccgtctcctcagctagc

SEQ ID NO: 2122 - DNA, 386 bp, Artificial Sequence
  gi|Fabrus|E05_VH3-23_IGHD6-19*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagtggctggtacgtcctacgctgaatacttccagcactggggccaaggaaccctggtcaccgtctcctcagctagc

SEQ ID NO: 2123 - DNA, 383 bp, Artificial Sequence
  gi|Fabrus|E06_VH3-23_IGHD6-25*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcggctactcctacgctgaatacttccagcactggggccaaggaaccctggtcaccgtctcctcagctagc

SEQ ID NO: 2124 - DNA, 383 bp, Artificial Sequence
  gi|Fabrus|E07_VH3-23_IGHD6-25*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcggctacgtcctacgctgaatacttccagcactggggccaaggaaccctggtcaccgtctcctcagctagc

SEQ ID NO: 2125 - DNA, 377 bp, Artificial Sequence
  gi|Fabrus|E08_VH3-23_IGHD7-27*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaactaactggggagtcctacgctgaatacttccagcactggggccaaggaaccctggtcaccgtctcctcagctagc

SEQ ID NO: 2126 - DNA, 377 bp, Artificial Sequence
  gi|Fabrus|E09_VH3-23_IGHD7-27*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagctaactggggatcctacgctgaatacttccagcactggggccaaggaaccctggtcaccgtctcctcagctagc

SEQ ID NO: 2127 - DNA, 383 bp, Artificial Sequence
  gi|Fabrus|A01_VH3-23_IGHD1-1*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttgtaccgtcctacgctgaatacttccagcactggggccaaggaaccctggtcaccgtctcctcagctagc

SEQ ID NO: 2128 - DNA, 383 bp, Artificial Sequence
  gi|Fabrus|A02_VH3-23_IGHD1-1*01>2'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttgtaccggtcctacgctgaatacttccagcactggggccaaggaaccctggtcaccgtctcctcagctagc

SEQ ID NO: 2129 - DNA, 383 bp, Artificial Sequence
  gi|Fabrus|A03_VH3-23_IGHD1-1*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttgtacctcctacgctgaatacttccagcactggggccaaggaaccctggtcaccgtctcctcagctagc

SEQ ID NO: 2130 - DNA, 383 bp, Artificial Sequence
  gi|Fabrus|A04_VH3-23_IGHD1-7*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttccagttataccgtcctacgctgaatacttccagcactggggccaaggaaccctggtcaccgtctcctcagctagc

SEQ ID NO: 2131 - DNA, 383 bp, Artificial Sequence
  gi|Fabrus|A05_VH3-23_IGHD1-7*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttccagttatacctcctacgctgaatacttccagcactggggccaaggaaccctggtcaccgtctcctcagctagc

SEQ ID NO: 2132 - DNA, 383 bp, Artificial Sequence
  gi|Fabrus|A06_VH3-23_IGHD1-14*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggttccggttataccgtcctacgctgaatacttccagcactggggccaaggaaccctggtcaccgtctcctcagctagc

SEQ ID NO: 2133 - DNA, 383 bp, Artificial Sequence
  gi|Fabrus|A07_VH3-23_IGHD1-14*01>2'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggttccggttataccggtcctacgctgaatacttccagcactggggccaaggaaccctggtcaccgtctcctcagctagc

SEQ ID NO: 2134 - DNA, 383 bp, Artificial Sequence
  gi|Fabrus|A08_VH3-23_IGHD1-14*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggttccggttatacctcctacgctgaatacttccagcactggggccaaggaaccctggtcaccgtctcctcagctagc

SEQ ID NO: 2135 - DNA, 383 bp, Artificial Sequence
  gi|Fabrus|A09_VH3-23_IGHD1-20*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttataccgtcctacgctgaatacttccagcactggggccaaggaaccctggtcaccgtctcctcagctagc

SEQ ID NO: 2136 - DNA, 383 bp, Artificial Sequence
  gi|Fabrus|A10_VH3-23_IGHD1-20*01>2'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttataccggtcctacgctgaatacttccagcactggggccaaggaaccctggtcaccgtctcctcagctagc

SEQ ID NO: 2137 - DNA, 383 bp, Artificial Sequence
  gi|Fabrus|A11_VH3-23_IGHD1-20*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttatacctcctacgctgaatacttccagcactggggccaaggaaccctggtcaccgtctcctcagctagc

SEQ ID NO: 2138 - DNA, 386 bp, Artificial Sequence
  gi|Fabrus|A12_VH3-23_IGHD1-26*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtagctcccactataccgtcctacgctgaatacttccagcactggggccaaggaaccctggtcaccgtctcctcagctagc

SEQ ID NO: 2139 - DNA, 386 bp, Artificial Sequence
  gi|Fabrus|B01_VH3-23_IGHD1-26*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtagctcccactatacctcctacgctgaatacttccagcactggggccaaggaaccctggtcaccgtctcctcagctagc

SEQ ID NO: 2140 - DNA, 395 bp, Artificial Sequence
  gi|Fabrus|B02_VH3-23_IGHD2-2*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcatagcagctggtactactacaatatcctcctacgctgaatacttccagcactggggccaaggaaccctggtcaccgtctcctcagctagc

SEQ ID NO: 2141 - DNA, 395 bp, Artificial Sequence
  gi|Fabrus|B03_VH3-23_IGHD2-2*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggcatagcagctggtactactacaatatctcctacgctgaatacttccagcactggggccaaggaaccctggtcaccgtctcctcagctagc

SEQ ID NO: 2142 - DNA, 395 bp, Artificial Sequence
  gi|Fabrus|B04_VH3-23_IGHD2-8*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcatacaccattagtacaatatcctcctacgctgaatacttccagcactggggccaaggaaccctggtcaccgtctcctcagctagc

SEQ ID NO: 2143 - DNA, 395 bp, Artificial Sequence
  gi|Fabrus|B05_VH3-23_IGHD2-15*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagtagcagctaccaccactacaatatcctcctacgctgaatacttccagcactggggccaaggaaccctggtcaccgtctcctcagctagc

SEQ ID NO: 2144 - DNA, 395 bp, Artificial Sequence
  gi|Fabrus|B06_VH3-23_IGHD2-15*01>3'_IGHJ1*0
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagtagcagctaccaccactacaatatctcctacgctgaatacttccagcactggggccaaggaaccctggtcaccgtctcctcagctagc

SEQ ID NO: 2145 - DNA, 392 bp, Artificial Sequence
  gi|Fabrus|B07_VH3-23_IGHD2-21*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggaatagcaatcaccaccacaatatgctcctacgctgaatacttccagcactggggccaaggaaccctggtcaccgtctcctcagctagc

SEQ ID NO: 2146 - DNA, 392 bp, Artificial Sequence
  gi|Fabrus|B08_VH3-23_IGHD2-21*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggaatagcaatcaccaccacaatatgtcctacgctgaatacttccagcactggggccaaggaaccctggtcaccgtctcctcagctagc

SEQ ID NO: 2147 - DNA, 395 bp, Artificial Sequence
  gi|Fabrus|B09_VH3-23_IGHD3-3*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataataaccactccaaaaatcgtaatatcctacgctgaatacttccagcactggggccaaggaaccctggtcaccgtctcctcagctagc

SEQ ID NO: 2148 - DNA, 395 bp, Artificial Sequence
  gi|Fabrus|B10_VH3-23_IGHD3-3*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataataaccactccaaaaatcgtaattcctacgctgaatacttccagcactggggccaaggaaccctggtcaccgtctcctcagctagc

SEQ ID NO: 2149 - DNA, 395 bp, Artificial Sequence
  gi|Fabrus|B11_VH3-23_IGHD3-9*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataaccagtcaaaatatcgtaatatcctacgctgaatacttccagcactggggccaaggaaccctggtcaccgtctcctcagctagc

SEQ ID NO: 2150 - DNA, 395 bp, Artificial Sequence
  gi|Fabrus|B12_VH3-23_IGHD3-9*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataaccagtcaaaatatcgtaattcctacgctgaatacttccagcactggggccaaggaaccctggtcaccgtctcctcagctagc

SEQ ID NO: 2151 - DNA, 395 bp, Artificial Sequence
  gi|Fabrus|C01_VH3-23_IGHD3-10*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataactccccgaaccatagtaatatcctacgctgaatacttccagcactggggccaaggaaccctggtcaccgtctcctcagctagc

SEQ ID NO: 2152 - DNA, 395 bp, Artificial Sequence
  gi|Fabrus|C02_VH3-23_IGHD3-10*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataactccccgaaccatagtaattcctacgctgaatacttccagcactggggccaaggaaccctggtcaccgtctcctcagctagc

SEQ ID NO: 2153 - DNA, 401 bp, Artificial Sequence
  gi|Fabrus|C03_VH3-23_IGHD3-16*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataagcataactcccccaaacgtaatcataatatcctacgctgaatacttccagcactggggccaaggaaccctggtcaccgtctcctcagctagc

SEQ ID NO: 2154 - DNA, 401 bp, Artificial Sequence
  gi|Fabrus|C04_VH3-23_IGHD3-16*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataagcataactcccccaaacgtaatcataattcctacgctgaatacttccagcactggggccaaggaaccctggtcaccgtctcctcagctagc

SEQ ID NO: 2155 - DNA, 395 bp, Artificial Sequence
  gi|Fabrus|C05_VH3-23_IGHD3-22*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtaataaccactactatcatagtaatatcctacgctgaatacttccagcactggggccaaggaaccctggtcaccgtctcctcagctagc

SEQ ID NO: 2156 - DNA, 380 bp, Artificial Sequence
  gi|Fabrus|C06_VH3-23_IGHD4-4*01(1)>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttactgtagtctcctacgctgaatacttccagcactggggccaaggaaccctggtcaccgtctcctcagctagc

SEQ ID NO: 2157 - DNA, 380 bp, Artificial Sequence
  gi|Fabrus|C07_VH3-23_IGHD4-4*01(1)>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttactgtagttcctacgctgaatacttccagcactggggccaaggaaccctggtcaccgtctcctcagctagc

SEQ ID NO: 2158 - DNA, 380 bp, Artificial Sequence; identical to SEQ ID NO: 2156
  gi|Fabrus|C08_VH3-23_IGHD4-11*01(1)>1'_IGHJ1*01

SEQ ID NO: 2159 - DNA, 380 bp, Artificial Sequence; identical to SEQ ID NO: 2157
  gi|Fabrus|C09_VH3-23_IGHD4-11*01(1)>3'_IGHJ1*01

SEQ ID NO: 2160 - DNA, 380 bp, Artificial Sequence
  gi|Fabrus|C10_VH3-23_IGHD4-17*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtcaccgtagtctcctacgctgaatacttccagcactggggccaaggaaccctggtcaccgtctcctcagctagc

SEQ ID NO: 2161 - DNA, 380 bp, Artificial Sequence
  gi|Fabrus|C11_VH3-23_IGHD4-17*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtcaccgtagttcctacgctgaatacttccagcactggggccaaggaaccctggtcaccgtctcctcagctagc

SEQ ID NO: 2162 - DNA, 383 bp, Artificial Sequence
  gi|Fabrus|C12_VH3-23_IGHD4-23*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagttaccaccgtagtctcctacgctgaatacttccagcactggggccaaggaaccctggtcaccgtctcctcagctagc

SEQ ID NO: 2163 - DNA, 383 bp, Artificial Sequence
  gi|Fabrus|D01_VH3-23_IGHD4-23*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagttaccaccgtagttcctacgctgaatacttccagcactggggccaaggaaccctggtcaccgtctcctcagctagc

SEQ ID NO: 2164 - DNA, 386 bp, Artificial Sequence
  gi|Fabrus|D02_VH3-23_IGHD5-5*01(2)>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaaccatagctgtatccacgtcctacgctgaatacttccagcactggggccaaggaaccctggtcaccgtctcctcagctagc

SEQ ID NO: 2165 - DNA, 386 bp, Artificial Sequence
  gi|Fabrus|D03_VH3-23_IGHD5-5*01(2)>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaaccatagctgtatccactcctacgctgaatacttccagcactggggccaaggaaccctggtcaccgtctcctcagctagc

SEQ ID NO: 2166 - DNA, 389 bp, Artificial Sequence
  gi|Fabrus|D04_VH3-23_IGHD5-12*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaatcgtagccactatatccacgtcctacgctgaatacttccagcactggggccaaggaaccctggtcaccgtctcctcagctagc

SEQ ID NO: 2167 - DNA, 389 bp, Artificial Sequence
  gi|Fabrus|D05_VH3-23_IGHD5-12*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaatcgtagccactatatccactcctacgctgaatacttccagcactggggccaaggaaccctggtcaccgtctcctcagctagc

SEQ ID NO: 2168 - DNA, 386 bp, Artificial Sequence; identical to SEQ ID NO: 2164
  gi|Fabrus|D06_VH3-23_IGHD5-18*01(2)>1'_IGHJ1*01

SEQ ID NO: 2169 - DNA, 386 bp, Artificial Sequence; identical to SEQ ID NO: 2165
  gi|Fabrus|D07_VH3-23_IGHD5-18*01(2)>3'_IGHJ1*01

SEQ ID NO: 2170 - DNA, 386 bp, Artificial Sequence
  gi|Fabrus|D08_VH3-23_IGHD5-24*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaattgtagccatctctacgtcctacgctgaatacttccagcactggggccaaggaaccctggtcaccgtctcctcagctagc

SEQ ID NO: 2171 - DNA, 386 bp, Artificial Sequence
  gi|Fabrus|D09_VH3-23_IGHD5-24*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaattgtagccatctctactcctacgctgaatacttccagcactggggccaaggaaccctggtcaccgtctcctcagctagc

SEQ ID NO: 2172 - DNA, 383 bp, Artificial Sequence
  gi|Fabrus|D10_VH3-23_IGHD6-6*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggacgagctgctatactctcctacgctgaatacttccagcactggggccaaggaaccctggtcaccgtctcctcagctagc

SEQ ID NO: 2173 - DNA, 383 bp, Artificial Sequence
  gi|Fabrus|D11_VH3-23_IGHD6-6*01>2'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagacgagctgctatactcgtcctacgctgaatacttccagcactggggccaaggaaccctggtcaccgtctcctcagctagc

SEQ ID NO: 2174 - DNA, 383 bp, Artificial Sequence
  gi|Fabrus|D12_VH3-23_IGHD6-6*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggacgagctgctatacttcctacgctgaatacttccagcactggggccaaggaaccctggtcaccgtctcctcagctagc

SEQ ID NO: 2175 - DNA, 386 bp, Artificial Sequence
  gi|Fabrus|E01_VH3-23_IGHD6-13*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagctgctgctataccctcctacgctgaatacttccagcactggggccaaggaaccctggtcaccgtctcctcagctagc

SEQ ID NO: 2176 - DNA, 386 bp, Artificial Sequence
  gi|Fabrus|E02_VH3-23_IGHD6-13*01>2'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagctgctgctatacccgtcctacgctgaatacttccagcactggggccaaggaaccctggtcaccgtctcctcagctagc

SEQ ID NO: 2177 - DNA, 386 bp, Artificial Sequence
  gi|Fabrus|E03_VH3-23_IGHD6-13*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagctgctgctatacctcctacgctgaatacttccagcactggggccaaggaaccctggtcaccgtctcctcagctagc

SEQ ID NO: 2178 - DNA, 386 bp, Artificial Sequence
  gi|Fabrus|E04_VH3-23_IGHD6-19*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagccactgctataccctcctacgctgaatacttccagcactggggccaaggaaccctggtcaccgtctcctcagctagc

SEQ ID NO: 2179 - DNA, 386 bp, Artificial Sequence
  gi|Fabrus|E05_VH3-23_IGHD6-19*01>2'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagccactgctatacccgtcctacgctgaatacttccagcactggggccaaggaaccctggtcaccgtctcctcagctagc

SEQ ID NO: 2180 - DNA, 386 bp, Artificial Sequence
  gi|Fabrus|E06_VH3-23_IGHD6-19*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagccactgctatacctcctacgctgaatacttccagcactggggccaaggaaccctggtcaccgtctcctcagctagc

SEQ ID NO: 2181 - DNA, 383 bp, Artificial Sequence
  gi|Fabrus|E07_VH3-23_IGHD6-25*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagccgctgctataccctcctacgctgaatacttccagcactggggccaaggaaccctggtcaccgtctcctcagctagc

SEQ ID NO: 2182 - DNA, 383 bp, Artificial Sequence
  gi|Fabrus|E08_VH3-23_IGHD6-25*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagccgctgctatacctcctacgctgaatacttccagcactggggccaaggaaccctggtcaccgtctcctcagctagc

SEQ ID NO: 2183 - DNA, 377 bp, Artificial Sequence
  gi|Fabrus|E09_VH3-23_IGHD7-27*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatccccagttaggtcctacgctgaatacttccagcactggggccaaggaaccctggtcaccgtctcctcagctagc

SEQ ID NO: 2184 - DNA, 377 bp, Artificial Sequence
  gi|Fabrus|E10_VH3-23_IGHD7-27*01>2'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccccagttagggtcctacgctgaatacttccagcactggggccaaggaaccctggtcaccgtctcctcagctagc

SEQ ID NO: 2185 - DNA, 383 bp, Artificial Sequence
  gi|Fabrus|A01_VH3-23_IGHD1-1*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtacaactggaacgacgtcctactactggtacttcgattcctggggccaaggaaccctggtcaccgtctcctcagctagc

SEQ ID NO: 2186 - DNA, 383 bp, Artificial Sequence
  gi|Fabrus|A02_VH3-23_IGHD1-1*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtacaactggaacgacggtcctactactggtacttcgattcctggggccaaggaaccctggtcaccgtctcctcagctagc

SEQ ID NO: 2187 - DNA, 383 bp, Artificial Sequence
  gi|Fabrus|A03_VH3-23_IGHD1-1*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtacaactggaacgactcctactactggtacttcgattcctggggccaaggaaccctggtcaccgtctcctcagctagc

SEQ ID NO: 2188 - DNA, 383 bp, Artificial Sequence
  gi|Fabrus|A04_VH3-23_IGHD1-7*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaactacgtcctactactggtacttcgattcctggggccaaggaaccctggtcaccgtctcctcagctagc

SEQ ID NO: 2189 - DNA, 383 bp, Artificial Sequence
  gi|Fabrus|A05_VH3-23_IGHD1-7*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaactactcctactactggtacttcgattcctggggccaaggaaccctggtcaccgtctcctcagctagc

SEQ ID NO: 2190 - DNA, 383 bp, Artificial Sequence
  gi|Fabrus|A06_VH3-23_IGHD1-14*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataaccggaaccacgtcctactactggtacttcgattcctggggccaaggaaccctggtcaccgtctcctcagctagc

SEQ ID NO: 2191 - DNA, 383 bp, Artificial Sequence
  gi|Fabrus|A07_VH3-23_IGHD1-14*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataaccggaaccactcctactactggtacttcgattcctggggccaaggaaccctggtcaccgtctcctcagctagc

SEQ ID NO: 2192 - DNA, 383 bp, Artificial Sequence
  gi|Fabrus|A08_VH3-23_IGHD1-20*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaacgacgtcctactactggtacttcgattcctggggccaaggaaccctggtcaccgtctcctcagctagc

SEQ ID NO: 2193 - DNA, 383 bp, Artificial Sequence
  gi|Fabrus|A09_VH3-23_IGHD1-20*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaacgactcctactactggtacttcgattcctggggccaaggaaccctggtcaccgtctcctcagctagc

SEQ ID NO: 2194 - DNA, 386 bp, Artificial Sequence
  gi|Fabrus|A10_VH3-23_IGHD1-26*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagtgggagctactacgtcctactactggtacttcgattcctggggccaaggaaccctggtcaccgtctcctcagctagc

SEQ ID NO: 2195 - DNA, 386 bp, Artificial Sequence
  gi|Fabrus|A11_VH3-23_IGHD1-26*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagtgggagctactactcctactactggtacttcgattcctggggccaaggaaccctggtcaccgtctcctcagctagc

SEQ ID NO: 2196 - DNA, 395 bp, Artificial Sequence
  gi|Fabrus|A12_VH3-23_IGHD2-2*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtagtaccagctgctatgcctcctactactggtacttcgattcctggggccaaggaaccctggtcaccgtctcctcagctagc

SEQ ID NO: 2197 - DNA, 395 bp, Artificial Sequence
  gi|Fabrus|B01_VH3-23_IGHD2-2*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtagtaccagctgctatgtcctactactggtacttcgattcctggggccaaggaaccctggtcaccgtctcctcagctagc

SEQ ID NO: 2198 - DNA, 395 bp, Artificial Sequence
  gi|Fabrus|B02_VH3-23_IGHD2-8*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtactaatggtgtatgctatacctcctactactggtacttcgattcctggggccaaggaaccctggtcaccgtctcctcagctagc

SEQ ID NO: 2199 - DNA, 395 bp, Artificial Sequence
  gi|Fabrus|B03_VH3-23_IGHD2-8*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtactaatggtgtatgctatatcctactactggtacttcgattcctggggccaaggaaccctggtcaccgtctcctcagctagc

SEQ ID NO: 2200 - DNA, 395 bp, Artificial Sequence
  gi|Fabrus|B04_VH3-23_IGHD2-15*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtggtggtagctgctactcctcctactactggtacttcgattcctggggccaaggaaccctggtcaccgtctcctcagctagc

SEQ ID NO: 2201 - DNA, 395 bp, Artificial Sequence
  gi|Fabrus|B05_VH3-23_IGHD2-15*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtggtggtagctgctacttcctactactggtacttcgattcctggggccaaggaaccctggtcaccgtctcctcagctagc

SEQ ID NO: 2202 - DNA, 392 bp, Artificial Sequence
  gi|Fabrus|B06_VH3-23_IGHD2-21*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagcatattgtggtggtgattgctattcctcctactactggtacttcgattcctggggccaaggaaccctggtcaccgtctcctcagctagc

SEQ ID NO: 2203 - DNA, 392 bp, Artificial Sequence
  gi|Fabrus|B07_VH3-23_IGHD2-21*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagcatattgtggtggtgattgctatttcctactactggtacttcgattcctggggccaaggaaccctggtcaccgtctcctcagctagc

SEQ ID NO: 2204 - DNA, 395 bp, Artificial Sequence
  gi|Fabrus|B08_VH3-23_IGHD3-3*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtattacgatttttggagtggttattatactcctactactggtacttcgattcctggggccaaggaaccctggtcaccgtctcctcagctagc

SEQ ID NO: 2205 - DNA, 395 bp, Artificial Sequence
  gi|Fabrus|B09_VH3-23_IGHD3-3*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatttttggagtggttattatacctcctactactggtacttcgattcctggggccaaggaaccctggtcaccgtctcctcagctagc

SEQ ID NO: 2206 - DNA, 395 bp, Artificial Sequence
  gi|Fabrus|B10_VH3-23_IGHD3-3*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattacgatttttggagtggttattatatcctactactggtacttcgattcctggggccaaggaaccctggtcaccgtctcctcagctagc

SEQ ID NO: 2207 - DNA, 395 bp, Artificial Sequence
  gi|Fabrus|B11_VH3-23_IGHD3-9*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatattttgactggttattataactcctactactggtacttcgattcctggggccaaggaaccctggtcaccgtctcctcagctagc

SEQ ID NO: 2208 - DNA, 395 bp, Artificial Sequence
  gi|Fabrus|B12_VH3-23_IGHD3-10*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatggttcggggagttattataactcctactactggtacttcgattcctggggccaaggaaccctggtcaccgtctcctcagctagc

SEQ ID NO: 2209 - DNA, 395 bp, Artificial Sequence
  gi|Fabrus|C01_VH3-23_IGHD3-10*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatggttcggggagttattatatcctactactggtacttcgattcctggggccaaggaaccctggtcaccgtctcctcagctagc

SEQ ID NO: 2210 - DNA, 401 bp, Artificial Sequence
  gi|Fabrus|C02_VH3-23_IGHD3-16*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattatgattacgtttgggggagttatgcttatacctcctactactggtacttcgattcctggggccaaggaaccctggtcaccgtctcctcagctagc

SEQ ID NO: 2211 - DNA, 401 bp, Artificial Sequence
  gi|Fabrus|C03_VH3-23_IGHD3-16*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattatgattacgtttgggggagttatgcttatatcctactactggtacttcgattcctggggccaaggaaccctggtcaccgtctcctcagctagc

SEQ ID NO: 2212 - DNA, 395 bp, Artificial Sequence
  gi|Fabrus|C04_VH3-23_IGHD3-22*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatgatagtagtggttattactactcctactactggtacttcgattcctggggccaaggaaccctggtcaccgtctcctcagctagc

SEQ ID NO: 2213 - DNA, 395 bp, Artificial Sequence
  gi|Fabrus|C05_VH3-23_IGHD3-22*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatgatagtagtggttattacttcctactactggtacttcgattcctggggccaaggaaccctggtcaccgtctcctcagctagc

SEQ ID NO: 2214 - DNA, 380 bp, Artificial Sequence
  gi|Fabrus|C06_VH3-23_IGHD4-4*01(1)>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacagtaactactcctactactggtacttcgattcctggggccaaggaaccctggtcaccgtctcctcagctagc

SEQ ID NO: 2215 - DNA, 380 bp, Artificial Sequence
  gi|Fabrus|C07_VH3-23_IGHD4-4*01(1)>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacagtaacttcctactactggtacttcgattcctggggccaaggaaccctggtcaccgtctcctcagctagc

SEQ ID NO: 2216 - DNA, 380 bp, Artificial Sequence; identical to SEQ ID NO: 2214
  gi|Fabrus|C08_VH3-23_IGHD4-11*01(1)>2_IGHJ2*01

SEQ ID NO: 2217 - DNA, 380 bp, Artificial Sequence; identical to SEQ ID NO: 2215
  gi|Fabrus|C09_VH3-23_IGHD4-11*01(1)>3_IGHJ2*01

SEQ ID NO: 2218 - DNA, 380 bp, Artificial Sequence
  gi|Fabrus|C10_VH3-23_IGHD4-17*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtgactactcctactactggtacttcgattcctggggccaaggaaccctggtcaccgtctcctcagctagc

SEQ ID NO: 2219 - DNA, 380 bp, Artificial Sequence
  gi|Fabrus|C11_VH3-23_IGHD4-17*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtgacttcctactactggtacttcgattcctggggccaaggaaccctggtcaccgtctcctcagctagc

SEQ ID NO: 2220 - DNA, 383 bp, Artificial Sequence
  gi|Fabrus|C12_VH3-23_IGHD4-23*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtggtaactcctcctactactggtacttcgattcctggggccaaggaaccctggtcaccgtctcctcagctagc

SEQ ID NO: 2221 - DNA, 383 bp, Artificial Sequence
  gi|Fabrus|D01_VH3-23_IGHD4-23*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtggtaacttcctactactggtacttcgattcctggggccaaggaaccctggtcaccgtctcctcagctagc

SEQ ID NO: 2222 - DNA, 386 bp, Artificial Sequence
  gi|Fabrus|D02_VH3-23_IGHD5-5*01(2)>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatacagctatggttacgtcctactactggtacttcgattcctggggccaaggaaccctggtcaccgtctcctcagctagc

SEQ ID NO: 2223 - DNA, 386 bp, Artificial Sequence
  gi|Fabrus|D03_VH3-23_IGHD5-5*01(2)>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggatacagctatggttacggtcctactactggtacttcgattcctggggccaaggaaccctggtcaccgtctcctcagctagc

SEQ ID NO: 2224 - DNA, 386 bp, Artificial Sequence
  gi|Fabrus|D04_VH3-23_IGHD5-5*01(2)>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatacagctatggttactcctactactggtacttcgattcctggggccaaggaaccctggtcaccgtctcctcagctagc

SEQ ID NO: 2225 - DNA, 389 bp, Artificial Sequence
  gi|Fabrus|D05_VH3-23_IGHD5-12*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatatagtggctacgattacgtcctactactggtacttcgattcctggggccaaggaaccctggtcaccgtctcctcagctagc

SEQ ID NO: 2226 - DNA, 389 bp, Artificial Sequence
  gi|Fabrus|D06_VH3-23_IGHD5-12*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatatagtggctacgattactcctactactggtacttcgattcctggggccaaggaaccctggtcaccgtctcctcagctagc

SEQ ID NO: 2227 - DNA, 386 bp, Artificial Sequence; identical to SEQ ID NO: 2222
  gi|Fabrus|D07_VH3-23_IGHD5-18*01(2)>1_IGHJ2*01

SEQ ID NO: 2228 - DNA, 386 bp, Artificial Sequence; identical to SEQ ID NO: 2223
  gi|Fabrus|D08_VH3-23_IGHD5-18*01(2)>2_IGHJ2*01

SEQ ID NO: 2229 - DNA, 386 bp, Artificial Sequence; identical to SEQ ID NO: 2224
  gi|Fabrus|D09_VH3-23_IGHD5-18*01(2)>3_IGHJ2*01

SEQ ID NO: 2230 - DNA, 386 bp, Artificial Sequence
  gi|Fabrus|D10_VH3-23_IGHD5-24*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagagatggctacaattacgtcctactactggtacttcgattcctggggccaaggaaccctggtcaccgtctcctcagctagc

SEQ ID NO: 2231 - DNA, 386 bp, Artificial Sequence
  gi|Fabrus|D11_VH3-23_IGHD5-24*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagagatggctacaattactcctactactggtacttcgattcctggggccaaggaaccctggtcaccgtctcctcagctagc

SEQ ID NO: 2232 - DNA, 383 bp, Artificial Sequence
  gi|Fabrus|D12_VH3-23_IGHD6-6*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagtatagcagctcgtcctcctactactggtacttcgattcctggggccaaggaaccctggtcaccgtctcctcagctagc

SEQ ID NO: 2233 - DNA, 383 bp, Artificial Sequence
  gi|Fabrus|E01_VH3-23_IGHD6-6*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaagtatagcagctcgtccgtcctactactggtacttcgattcctggggccaaggaaccctggtcaccgtctcctcagctagc

SEQ ID NO: 2234 - DNA, 386 bp, Artificial Sequence
  gi|Fabrus|E02_VH3-23_IGHD6-13*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcagctggtactcctactactggtacttcgattcctggggccaaggaaccctggtcaccgtctcctcagctagc

SEQ ID NO: 2235 - DNA, 386 bp, Artificial Sequence
  gi|Fabrus|E03_VH3-23_IGHD6-13*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcagctggtacgtcctactactggtacttcgattcctggggccaaggaaccctggtcaccgtctcctcagctagc

SEQ ID NO: 2236 - DNA, 386 bp, Artificial Sequence
  gi|Fabrus|E04_VH3-23_IGHD6-19*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagtggctggtactcctactactggtacttcgattcctggggccaaggaaccctggtcaccgtctcctcagctagc

SEQ ID NO: 2237 - DNA, 386 bp, Artificial Sequence
  gi|Fabrus|E05_VH3-23_IGHD6-19*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagtggctggtacgtcctactactggtacttcgattcctggggccaaggaaccctggtcaccgtctcctcagctagc

SEQ ID NO: 2238 - DNA, 383 bp, Artificial Sequence
  gi|Fabrus|E06_VH3-23_IGHD6-25*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcggctactcctactactggtacttcgattcctggggccaaggaaccctggtcaccgtctcctcagctagc

SEQ ID NO: 2239 - DNA, 383 bp, Artificial Sequence
  gi|Fabrus|E07_VH3-23_IGHD6-25*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcggctacgtcctactactggtacttcgattcctggggccaaggaaccctggtcaccgtctcctcagctagc

SEQ ID NO: 2240 - DNA, 377 bp, Artificial Sequence
  gi|Fabrus|E08_VH3-23_IGHD7-27*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaactaactggggagtcctactactggtacttcgattcctggggccaaggaaccctggtcaccgtctcctcagctagc

SEQ ID NO: 2241 - DNA, 377 bp, Artificial Sequence
  gi|Fabrus|E09_VH3-23_IGHD7-27*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagctaactggggatcctactactggtacttcgattcctggggccaaggaaccctggtcaccgtctcctcagctagc

SEQ ID NO: 2242 - DNA, 383 bp, Artificial Sequence
  gi|Fabrus|A01_VH3-23_IGHD1-1*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttgtaccgtcctactactggtacttcgattcctggggccaaggaaccctggtcaccgtctcctcagctagc

SEQ ID NO: 2243 - DNA, 383 bp, Artificial Sequence
  gi|Fabrus|A02_VH3-23_IGHD1-1*01>2'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttgtaccggtcctactactggtacttcgattcctggggccaaggaaccctggtcaccgtctcctcagctagc

SEQ ID NO: 2244 - DNA, 383 bp, Artificial Sequence
  gi|Fabrus|A03_VH3-23_IGHD1-1*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttgtacctcctactactggtacttcgattcctggggccaaggaaccctggtcaccgtctcctcagctagc

SEQ ID NO: 2245 - DNA, 383 bp, Artificial Sequence
  gi|Fabrus|A04_VH3-23_IGHD1-7*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttccagttataccgtcctactactggtacttcgattcctggggccaaggaaccctggtcaccgtctcctcagctagc

SEQ ID NO: 2246 - DNA, 383 bp, Artificial Sequence
  gi|Fabrus|A05_VH3-23_IGHD1-7*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttccagttatacctcctactactggtacttcgattcctggggccaaggaaccctggtcaccgtctcctcagctagc

SEQ ID NO: 2247 - DNA, 383 bp, Artificial Sequence
  gi|Fabrus|A06_VH3-23_IGHD1-14*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggttccggttataccgtcctactactggtacttcgattcctggggccaaggaaccctggtcaccgtctcctcagctagc

SEQ ID NO: 2248 - DNA, 383 bp, Artificial Sequence
  gi|Fabrus|A07_VH3-23_IGHD1-14*01>2'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggttccggttataccggtcctactactggtacttcgattcctggggccaaggaaccctggtcaccgtctcctcagctagc

SEQ ID NO: 2249 - DNA, 383 bp, Artificial Sequence
  gi|Fabrus|A08_VH3-23_IGHD1-14*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggttccggttatacctcctactactggtacttcgattcctggggccaaggaaccctggtcaccgtctcctcagctagc

SEQ ID NO: 2250 - DNA, 383 bp, Artificial Sequence
  gi|Fabrus|A09_VH3-23_IGHD1-20*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttataccgtcctactactggtacttcgattcctggggccaaggaaccctggtcaccgtctcctcagctagc

SEQ ID NO: 2251 - DNA, 383 bp, Artificial Sequence
  gi|Fabrus|A10_VH3-23_IGHD1-20*01>2'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttataccggtcctactactggtacttcgattcctggggccaaggaaccctggtcaccgtctcctcagctagc

SEQ ID NO: 2252 - DNA, 383 bp, Artificial Sequence
  gi|Fabrus|A11_VH3-23_IGHD1-20*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttatacctcctactactggtacttcgattcctggggccaaggaaccctggtcaccgtctcctcagctagc

SEQ ID NO: 2253 - DNA, 386 bp, Artificial Sequence
  gi|Fabrus|A12_VH3-23_IGHD1-26*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtagctcccactataccgtcctactactggtacttcgattcctggggccaaggaaccctggtcaccgtctcctcagctagc

SEQ ID NO: 2254 - DNA, 386 bp, Artificial Sequence
  gi|Fabrus|B01_VH3-23_IGHD1-26*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtagctcccactatacctcctactactggtacttcgattcctggggccaaggaaccctggtcaccgtctcctcagctagc

SEQ ID NO: 2255 - DNA, 395 bp, Artificial Sequence
  gi|Fabrus|B02_VH3-23_IGHD2-2*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcatagcagctggtactactacaatatcctcctactactggtacttcgattcctggggccaaggaaccctggtcaccgtctcctcagctagc

SEQ ID NO: 2256 - DNA, 395 bp, Artificial Sequence
  gi|Fabrus|B03_VH3-23_IGHD2-2*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggcatagcagctggtactactacaatatctcctactactggtacttcgattcctggggccaaggaaccctggtcaccgtctcctcagctagc

SEQ ID NO: 2257 - DNA, 395 bp, Artificial Sequence
  gi|Fabrus|B04_VH3-23_IGHD2-8*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcatacaccattagtacaatatcctcctactactggtacttcgattcctggggccaaggaaccctggtcaccgtctcctcagctagc

SEQ ID NO: 2258 - DNA, 395 bp, Artificial Sequence
  gi|Fabrus|B05_VH3-23_IGHD2-15*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagtagcagctaccaccactacaatatcctcctactactggtacttcgattcctggggccaaggaaccctggtcaccgtctcctcagctagc

SEQ ID NO: 2259 - DNA, 395 bp, Artificial Sequence
  gi|Fabrus|B06_VH3-23_IGHD2-15*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagtagcagctaccaccactacaatatctcctactactggtacttcgattcctggggccaaggaaccctggtcaccgtctcctcagctagc

SEQ ID NO: 2260 - DNA, 392 bp, Artificial Sequence
  gi|Fabrus|B07_VH3-23_IGHD2-21*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggaatagcaatcaccaccacaatatgctcctactactggtacttcgattcctggggccaaggaaccctggtcaccgtctcctcagctagc

SEQ ID NO: 2261 - DNA, 392 bp, Artificial Sequence
  gi|Fabrus|B08_VH3-23_IGHD2-21*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggaatagcaatcaccaccacaatatgtcctactactggtacttcgattcctggggccaaggaaccctggtcaccgtctcctcagctagc

SEQ ID NO: 2262 - DNA, 395 bp, Artificial Sequence
  gi|Fabrus|B09_VH3-23_IGHD3-3*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataataaccactccaaaaatcgtaatatcctactactggtacttcgattcctggggccaaggaaccctggtcaccgtctcctcagctagc

SEQ ID NO: 2263 - DNA, 395 bp, Artificial Sequence
  gi|Fabrus|B10_VH3-23_IGHD3-3*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataataaccactccaaaaatcgtaattcctactactggtacttcgattcctggggccaaggaaccctggtcaccgtctcctcagctagc

SEQ ID NO: 2264 - DNA, 395 bp, Artificial Sequence
  gi|Fabrus|B11_VH3-23_IGHD3-9*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataaccagtcaaaatatcgtaatatcctactactggtacttcgattcctggggccaaggaaccctggtcaccgtctcctcagctagc

SEQ ID NO: 2265 - DNA, 395 bp, Artificial Sequence
  gi|Fabrus|B12_VH3-23_IGHD3-9*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataaccagtcaaaatatcgtaattcctactactggtacttcgattcctggggccaaggaaccctggtcaccgtctcctcagctagc

SEQ ID NO: 2266 - DNA, 395 bp, Artificial Sequence
  gi|Fabrus|C01_VH3-23_IGHD3-10*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataactccccgaaccatagtaatatcctactactggtacttcgattcctggggccaaggaaccctggtcaccgtctcctcagctagc

SEQ ID NO: 2267 - DNA, 395 bp, Artificial Sequence
  gi|Fabrus|C02_VH3-23_IGHD3-10*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataactccccgaaccatagtaattcctactactggtacttcgattcctggggccaaggaaccctggtcaccgtctcctcagctagc

SEQ ID NO: 2268 - DNA, 401 bp, Artificial Sequence
  gi|Fabrus|C03_VH3-23_IGHD3-16*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataagcataactcccccaaacgtaatcataatatcctactactggtacttcgattcctggggccaaggaaccctggtcaccgtctcctcagctagc

SEQ ID NO: 2269 - DNA, 401 bp, Artificial Sequence
  gi|Fabrus|C04_VH3-23_IGHD3-16*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataagcataactcccccaaacgtaatcataattcctactactggtacttcgattcctggggccaaggaaccctggtcaccgtctcctcagctagc

SEQ ID NO: 2270 - DNA, 395 bp, Artificial Sequence
  gi|Fabrus|C05_VH3-23_IGHD3-22*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtaataaccactactatcatagtaatatcctactactggtacttcgattcctggggccaaggaaccctggtcaccgtctcctcagctagc

SEQ ID NO: 2271 - DNA, 380 bp, Artificial Sequence
  gi|Fabrus|C06_VH3-23_IGHD4-4*01(1)>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttactgtagtctcctactactggtacttcgattcctggggccaaggaaccctggtcaccgtctcctcagctagc

SEQ ID NO: 2272 - DNA, 380 bp, Artificial Sequence
  gi|Fabrus|C07_VH3-23_IGHD4-4*01(1)>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttactgtagttcctactactggtacttcgattcctggggccaaggaaccctggtcaccgtctcctcagctagc

SEQ ID NO: 2273 - DNA, 380 bp, Artificial Sequence; identical to SEQ ID NO: 2271
  gi|Fabrus|C08_VH3-23_IGHD4-11*01(1)>1'_IGHJ2*01

SEQ ID NO: 2274 - DNA, 380 bp, Artificial Sequence; identical to SEQ ID NO: 2272
  gi|Fabrus|C09_VH3-23_IGHD4-11*01(1)>3'_IGHJ2*01

SEQ ID NO: 2275 - DNA, 380 bp, Artificial Sequence
  gi|Fabrus|C10_VH3-23_IGHD4-17*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtcaccgtagtctcctactactggtacttcgattcctggggccaaggaaccctggtcaccgtctcctcagctagc

SEQ ID NO: 2276 - DNA, 380 bp, Artificial Sequence
  gi|Fabrus|C11_VH3-23_IGHD4-17*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtcaccgtagttcctactactggtacttcgattcctggggccaaggaaccctggtcaccgtctcctcagctagc

SEQ ID NO: 2277 - DNA, 383 bp, Artificial Sequence
  gi|Fabrus|C12_VH3-23_IGHD4-23*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagttaccaccgtagtctcctactactggtacttcgattcctggggccaaggaaccctggtcaccgtctcctcagctagc

SEQ ID NO: 2278 - DNA, 383 bp, Artificial Sequence
  gi|Fabrus|D01_VH3-23_IGHD4-23*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagttaccaccgtagttcctactactggtacttcgattcctggggccaaggaaccctggtcaccgtctcctcagctagc

SEQ ID NO: 2279 - DNA, 386 bp, Artificial Sequence
  gi|Fabrus|D02_VH3-23_IGHD5-5*01(2)>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaaccatagctgtatccacgtcctactactggtacttcgattcctggggccaaggaaccctggtcaccgtctcctcagctagc

SEQ ID NO: 2280 - DNA, 386 bp, Artificial Sequence
  gi|Fabrus|D03_VH3-23_IGHD5-5*01(2)>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaaccatagctgtatccactcctactactggtacttcgattcctggggccaaggaaccctggtcaccgtctcctcagctagc

SEQ ID NO: 2281 - DNA, 389 bp, Artificial Sequence
  gi|Fabrus|D04_VH3-23_IGHD5-12*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaatcgtagccactatatccacgtcctactactggtacttcgattcctggggccaaggaaccctggtcaccgtctcctcagctagc

SEQ ID NO: 2282 - DNA, 389 bp, Artificial Sequence
  gi|Fabrus|D05_VH3-23_IGHD5-12*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaatcgtagccactatatccactcctactactggtacttcgattcctggggccaaggaaccctggtcaccgtctcctcagctagc

SEQ ID NO: 2283 - DNA, 386 bp, Artificial Sequence; identical to SEQ ID NO: 2279
  gi|Fabrus|D06_VH3-23_IGHD5-18*01(2)>1'_IGHJ2*01

SEQ ID NO: 2284 - DNA, 386 bp, Artificial Sequence; identical to SEQ ID NO: 2280
  gi|Fabrus|D07_VH3-23_IGHD5-18*01(2)>3'_IGHJ2*01

SEQ ID NO: 2285 - DNA, 386 bp, Artificial Sequence
  gi|Fabrus|D08_VH3-23_IGHD5-24*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaattgtagccatctctacgtcctactactggtacttcgattcctggggccaaggaaccctggtcaccgtctcctcagctagc

SEQ ID NO: 2286 - DNA, 386 bp, Artificial Sequence
  gi|Fabrus|D09_VH3-23_IGHD5-24*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaattgtagccatctctactcctactactggtacttcgattcctggggccaaggaaccctggtcaccgtctcctcagctagc

SEQ ID NO: 2287 - DNA, 383 bp, Artificial Sequence
  gi|Fabrus|D10_VH3-23_IGHD6-6*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggacgagctgctatactctcctactactggtacttcgattcctggggccaaggaaccctggtcaccgtctcctcagctagc

SEQ ID NO: 2288 - DNA, 383 bp, Artificial Sequence
  gi|Fabrus|D11_VH3-23_IGHD6-6*01>2'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagacgagctgctatactcgtcctactactggtacttcgattcctggggccaaggaaccctggtcaccgtctcctcagctagc

SEQ ID NO: 2289 - DNA, 383 bp, Artificial Sequence
  gi|Fabrus|D12_VH3-23_IGHD6-6*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggacgagctgctatacttcctactactggtacttcgattcctggggccaaggaaccctggtcaccgtctcctcagctagc

SEQ ID NO: 2290 - DNA, 386 bp, Artificial Sequence
  gi|Fabrus|E01_VH3-23_IGHD6-13*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagctgctgctataccctcctactactggtacttcgattcctggggccaaggaaccctggtcaccgtctcctcagctagc

SEQ ID NO: 2291 - DNA, 386 bp, Artificial Sequence
  gi|Fabrus|E02_VH3-23_IGHD6-13*01>2'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagctgctgctatacccgtcctactactggtacttcgattcctggggccaaggaaccctggtcaccgtctcctcagctagc

SEQ ID NO: 2292 - DNA, 386 bp, Artificial Sequence
  gi|Fabrus|E03_VH3-23_IGHD6-13*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagctgctgctatacctcctactactggtacttcgattcctggggccaaggaaccctggtcaccgtctcctcagctagc

SEQ ID NO: 2293 - DNA, 386 bp, Artificial Sequence
  gi|Fabrus|E04_VH3-23_IGHD6-19*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagccactgctataccctcctactactggtacttcgattcctggggccaaggaaccctggtcaccgtctcctcagctagc

SEQ ID NO: 2294 - DNA, 386 bp, Artificial Sequence
  gi|Fabrus|E05_VH3-23_IGHD6-19*01>2'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagccactgctatacccgtcctactactggtacttcgattcctggggccaaggaaccctggtcaccgtctcctcagctagc

SEQ ID NO: 2295 - DNA, 386 bp, Artificial Sequence
  gi|Fabrus|E06_VH3-23_IGHD6-19*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagccactgctatacctcctactactggtacttcgattcctggggccaaggaaccctggtcaccgtctcctcagctagc

SEQ ID NO: 2296 - DNA, 383 bp, Artificial Sequence
  gi|Fabrus|E07_VH3-23_IGHD6-25*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagccgctgctataccctcctactactggtacttcgattcctggggccaaggaaccctggtcaccgtctcctcagctagc

SEQ ID NO: 2297 - DNA, 383 bp, Artificial Sequence
  gi|Fabrus|E08_VH3-23_IGHD6-25*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagccgctgctatacctcctactactggtacttcgattcctggggccaaggaaccctggtcaccgtctcctcagctagc

SEQ ID NO: 2298 - DNA, 377 bp, Artificial Sequence
  gi|Fabrus|E09_VH3-23_IGHD7-27*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatccccagttaggtcctactactggtacttcgattcctggggccaaggaaccctggtcaccgtctcctcagctagc

SEQ ID NO: 2299 - DNA, 377 bp, Artificial Sequence
  gi|Fabrus|E10_VH3-23_IGHD7-27*01>2'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccccagttagggtcctactactggtacttcgattcctggggccaaggaaccctggtcaccgtctcctcagctagc

SEQ ID NO: 2300 - DNA, 377 bp, Artificial Sequence
  gi|Fabrus|A01_VH3-23_IGHD1-1*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtacaactggaacgacgtcctatgcttttgatgtctggggccaaggaaccctggtcaccgtctcctcagctagc

SEQ ID NO: 2301 - DNA, 377 bp, Artificial Sequence
  gi|Fabrus|A02_VH3-23_IGHD1-1*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtacaactggaacgacggtcctatgcttttgatgtctggggccaaggaaccctggtcaccgtctcctcagctagc

SEQ ID NO: 2302 - DNA, 377 bp, Artificial Sequence
  gi|Fabrus|A03_VH3-23_IGHD1-1*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtacaactggaacgactcctatgcttttgatgtctggggccaaggaaccctggtcaccgtctcctcagctagc

SEQ ID NO: 2303 - DNA, 377 bp, Artificial Sequence
  gi|Fabrus|A04_VH3-23_IGHD1-7*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaactacgtcctatgcttttgatgtctggggccaaggaaccctggtcaccgtctcctcagctagc

SEQ ID NO: 2304 - DNA, 377 bp, Artificial Sequence
  gi|Fabrus|A05_VH3-23_IGHD1-7*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaactactcctatgcttttgatgtctggggccaaggaaccctggtcaccgtctcctcagctagc

SEQ ID NO: 2305 - DNA, 377 bp, Artificial Sequence
  gi|Fabrus|A06_VH3-23_IGHD1-14*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataaccggaaccacgtcctatgcttttgatgtctggggccaaggaaccctggtcaccgtctcctcagctagc

SEQ ID NO: 2306 - DNA, 377 bp, Artificial Sequence
  gi|Fabrus|A07_VH3-23_IGHD1-14*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataaccggaaccactcctatgcttttgatgtctggggccaaggaaccctggtcaccgtctcctcagctagc

SEQ ID NO: 2307 - DNA, 377 bp, Artificial Sequence
  gi|Fabrus|A08_VH3-23_IGHD1-20*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaacgacgtcctatgcttttgatgtctggggccaaggaaccctggtcaccgtctcctcagctagc

SEQ ID NO: 2308 - DNA, 377 bp, Artificial Sequence
  gi|Fabrus|A09_VH3-23_IGHD1-20*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaacgactcctatgcttttgatgtctggggccaaggaaccctggtcaccgtctcctcagctagc

SEQ ID NO: 2309 - DNA, 380 bp, Artificial Sequence
  gi|Fabrus|A10_VH3-23_IGHD1-26*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagtgggagctactacgtcctatgcttttgatgtctggggccaaggaaccctggtcaccgtctcctcagctagc

SEQ ID NO: 2310 - DNA, 380 bp, Artificial Sequence
  gi|Fabrus|A11_VH3-23_IGHD1-26*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagtgggagctactactcctatgcttttgatgtctggggccaaggaaccctggtcaccgtctcctcagctagc

SEQ ID NO: 2311 - DNA, 389 bp, Artificial Sequence
  gi|Fabrus|A12_VH3-23_IGHD2-2*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtagtaccagctgctatgcctcctatgcttttgatgtctggggccaaggaaccctggtcaccgtctcctcagctagc

SEQ ID NO: 2312 - DNA, 389 bp, Artificial Sequence
  gi|Fabrus|B01_VH3-23_IGHD2-2*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtagtaccagctgctatgtcctatgcttttgatgtctggggccaaggaaccctggtcaccgtctcctcagctagc

SEQ ID NO: 2313 - DNA, 389 bp, Artificial Sequence
  gi|Fabrus|B02_VH3-23_IGHD2-8*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtactaatggtgtatgctatacctcctatgcttttgatgtctggggccaaggaaccctggtcaccgtctcctcagctagc

SEQ ID NO: 2314 - DNA, 389 bp, Artificial Sequence
  gi|Fabrus|B03_VH3-23_IGHD2-8*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtactaatggtgtatgctatatcctatgcttttgatgtctggggccaaggaaccctggtcaccgtctcctcagctagc

SEQ ID NO: 2315 - DNA, 389 bp, Artificial Sequence
  gi|Fabrus|B04_VH3-23_IGHD2-15*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtggtggtagctgctactcctcctatgcttttgatgtctggggccaaggaaccctggtcaccgtctcctcagctagc

SEQ ID NO: 2316 - DNA, 389 bp, Artificial Sequence
  gi|Fabrus|B05_VH3-23_IGHD2-15*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtggtggtagctgctacttcctatgcttttgatgtctggggccaaggaaccctggtcaccgtctcctcagctagc

SEQ ID NO: 2317 - DNA, 386 bp, Artificial Sequence
  gi|Fabrus|B06_VH3-23_IGHD2-21*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagcatattgtggtggtgattgctattcctcctatgcttttgatgtctggggccaaggaaccctggtcaccgtctcctcagctagc

SEQ ID NO: 2318 - DNA, 386 bp, Artificial Sequence
  gi|Fabrus|B07_VH3-23_IGHD2-21*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagcatattgtggtggtgattgctatttcctatgcttttgatgtctggggccaaggaaccctggtcaccgtctcctcagctagc

SEQ ID NO: 2319 - DNA, 389 bp, Artificial Sequence
  gi|Fabrus|B08_VH3-23_IGHD3-3*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtattacgatttttggagtggttattatactcctatgcttttgatgtctggggccaaggaaccctggtcaccgtctcctcagctagc

SEQ ID NO: 2320 - DNA, 389 bp, Artificial Sequence
  gi|Fabrus|B09_VH3-23_IGHD3-3*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatttttggagtggttattatacctcctatgcttttgatgtctggggccaaggaaccctggtcaccgtctcctcagctagc

SEQ ID NO: 2321 - DNA, 389 bp, Artificial Sequence
  gi|Fabrus|B10_VH3-23_IGHD3-3*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattacgatttttggagtggttattatatcctatgcttttgatgtctggggccaaggaaccctggtcaccgtctcctcagctagc

SEQ ID NO: 2322 - DNA, 389 bp, Artificial Sequence
  gi|Fabrus|B11_VH3-23_IGHD3-9*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatattttgactggttattataactcctatgcttttgatgtctggggccaaggaaccctggtcaccgtctcctcagctagc

SEQ ID NO: 2323 - DNA, 389 bp, Artificial Sequence
  gi|Fabrus|B12_VH3-23_IGHD3-10*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatggttcggggagttattataactcctatgcttttgatgtctggggccaaggaaccctggtcaccgtctcctcagctagc

SEQ ID NO: 2324 - DNA, 389 bp, Artificial Sequence
  gi|Fabrus|C01_VH3-23_IGHD3-10*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatggttcggggagttattatatcctatgcttttgatgtctggggccaaggaaccctggtcaccgtctcctcagctagc

SEQ ID NO: 2325 - DNA, 395 bp, Artificial Sequence
  gi|Fabrus|C02_VH3-23_IGHD3-16*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattatgattacgtttgggggagttatgcttatacctcctatgcttttgatgtctggggccaaggaaccctggtcaccgtctcctcagctagc

SEQ ID NO: 2326 - DNA, 395 bp, Artificial Sequence
  gi|Fabrus|C03_VH3-23_IGHD3-16*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattatgattacgtttgggggagttatgcttatatcctatgcttttgatgtctggggccaaggaaccctggtcaccgtctcctcagctagc

SEQ ID NO: 2327 - DNA, 389 bp, Artificial Sequence
  gi|Fabrus|C04_VH3-23_IGHD3-22*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatgatagtagtggttattactactcctatgcttttgatgtctggggccaaggaaccctggtcaccgtctcctcagctagc

SEQ ID NO: 2328 - DNA, 389 bp, Artificial Sequence
  gi|Fabrus|C05_VH3-23_IGHD3-22*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatgatagtagtggttattacttcctatgcttttgatgtctggggccaaggaaccctggtcaccgtctcctcagctagc

SEQ ID NO: 2329 - DNA, 374 bp, Artificial Sequence
  gi|Fabrus|C06_VH3-23_IGHD4-4*01(1)>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacagtaactactcctatgcttttgatgtctggggccaaggaaccctggtcaccgtctcctcagctagc

SEQ ID NO: 2330 - DNA, 374 bp, Artificial Sequence
  gi|Fabrus|C07_VH3-23_IGHD4-4*01(1)>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacagtaacttcctatgcttttgatgtctggggccaaggaaccctggtcaccgtctcctcagctagc

SEQ ID NO: 2331 - DNA, 374 bp, Artificial Sequence; identical to SEQ ID NO: 2329
  gi|Fabrus|C08_VH3-23_IGHD4-11*01(1)>2_IGHJ3*01

SEQ ID NO: 2332 - DNA, 374 bp, Artificial Sequence; identical to SEQ ID NO: 2330
  gi|Fabrus|C09_VH3-23_IGHD4-11*01(1)>3_IGHJ3*01

SEQ ID NO: 2333 - DNA, 374 bp, Artificial Sequence
  gi|Fabrus|C10_VH3-23_IGHD4-17*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtgactactcctatgcttttgatgtctggggccaaggaaccctggtcaccgtctcctcagctagc

SEQ ID NO: 2334 - DNA, 374 bp, Artificial Sequence
  gi|Fabrus|C11_VH3-23_IGHD4-17*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtgacttcctatgcttttgatgtctggggccaaggaaccctggtcaccgtctcctcagctagc

SEQ ID NO: 2335 - DNA, 377 bp, Artificial Sequence
  gi|Fabrus|C12_VH3-23_IGHD4-23*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtggtaactcctcctatgcttttgatgtctggggccaaggaaccctggtcaccgtctcctcagctagc

SEQ ID NO: 2336 - DNA, 377 bp, Artificial Sequence
  gi|Fabrus|D01_VH3-23_IGHD4-23*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtggtaacttcctatgcttttgatgtctggggccaaggaaccctggtcaccgtctcctcagctagc

SEQ ID NO: 2337 - DNA, 380 bp, Artificial Sequence
  gi|Fabrus|D02_VH3-23_IGHD5-5*01(2)>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatacagctatggttacgtcctatgcttttgatgtctggggccaaggaaccctggtcaccgtctcctcagctagc

SEQ ID NO: 2338 - DNA, 380 bp, Artificial Sequence
  gi|Fabrus|D03_VH3-23_IGHD5-5*01(2)>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggatacagctatggttacggtcctatgcttttgatgtctggggccaaggaaccctggtcaccgtctcctcagctagc

SEQ ID NO: 2339 - DNA, 380 bp, Artificial Sequence
  gi|Fabrus|D04_VH3-23_IGHD5-5*01(2)>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatacagctatggttactcctatgcttttgatgtctggggccaaggaaccctggtcaccgtctcctcagctagc

SEQ ID NO: 2340 - DNA, 383 bp, Artificial Sequence
  gi|Fabrus|D05_VH3-23_IGHD5-12*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatatagtggctacgattacgtcctatgcttttgatgtctggggccaaggaaccctggtcaccgtctcctcagctagc

SEQ ID NO: 2341 - DNA, 383 bp, Artificial Sequence
  gi|Fabrus|D06_VH3-23_IGHD5-12*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatatagtggctacgattactcctatgcttttgatgtctggggccaaggaaccctggtcaccgtctcctcagctagc

SEQ ID NO: 2342 - DNA, 380 bp, Artificial Sequence; identical to SEQ ID NO: 2337
  gi|Fabrus|D07_VH3-23_IGHD5-18*01(2)>1_IGHJ3*01

SEQ ID NO: 2343 - DNA, 380 bp, Artificial Sequence; identical to SEQ ID NO: 2338
  gi|Fabrus|D08_VH3-23_IGHD5-18*01(2)>2_IGHJ3*01

SEQ ID NO: 2344 - DNA, 380 bp, Artificial Sequence; identical to SEQ ID NO: 2339
  gi|Fabrus|D09_VH3-23_IGHD5-18*01(2)>3_IGHJ3*01

SEQ ID NO: 2345 - DNA, 380 bp, Artificial Sequence
  gi|Fabrus|D10_VH3-23_IGHD5-24*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagagatggctacaattacgtcctatgcttttgatgtctggggccaaggaaccctggtcaccgtctcctcagctagc

SEQ ID NO: 2346 - DNA, 380 bp, Artificial Sequence
  gi|Fabrus|D11_VH3-23_IGHD5-24*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagagatggctacaattactcctatgcttttgatgtctggggccaaggaaccctggtcaccgtctcctcagctagc

SEQ ID NO: 2347 - DNA, 377 bp, Artificial Sequence
  gi|Fabrus|D12_VH3-23_IGHD6-6*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagtatagcagctcgtcctcctatgcttttgatgtctggggccaaggaaccctggtcaccgtctcctcagctagc

SEQ ID NO: 2348 - DNA, 377 bp, Artificial Sequence
  gi|Fabrus|E01_VH3-23_IGHD6-6*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaagtatagcagctcgtccgtcctatgcttttgatgtctggggccaaggaaccctggtcaccgtctcctcagctagc

SEQ ID NO: 2349 - DNA, 380 bp, Artificial Sequence
  gi|Fabrus|E02_VH3-23_IGHD6-13*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcagctggtactcctatgcttttgatgtctggggccaaggaaccctggtcaccgtctcctcagctagc

SEQ ID NO: 2350 - DNA, 380 bp, Artificial Sequence
  gi|Fabrus|E03_VH3-23_IGHD6-13*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcagctggtacgtcctatgcttttgatgtctggggccaaggaaccctggtcaccgtctcctcagctagc

SEQ ID NO: 2351 - DNA, 380 bp, Artificial Sequence
  gi|Fabrus|E04_VH3-23_IGHD6-19*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagtggctggtactcctatgcttttgatgtctggggccaaggaaccctggtcaccgtctcctcagctagc

SEQ ID NO: 2352 - DNA, 380 bp, Artificial Sequence
  gi|Fabrus|E05_VH3-23_IGHD6-19*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagtggctggtacgtcctatgcttttgatgtctggggccaaggaaccctggtcaccgtctcctcagctagc

SEQ ID NO: 2353 - DNA, 377 bp, Artificial Sequence
  gi|Fabrus|E06_VH3-23_IGHD6-25*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcggctactcctatgcttttgatgtctggggccaaggaaccctggtcaccgtctcctcagctagc

SEQ ID NO: 2354 - DNA, 377 bp, Artificial Sequence
  gi|Fabrus|E07_VH3-23_IGHD6-25*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcggctacgtcctatgcttttgatgtctggggccaaggaaccctggtcaccgtctcctcagctagc

SEQ ID NO: 2355 - DNA, 371 bp, Artificial Sequence
  gi|Fabrus|E08_VH3-23_IGHD7-27*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaactaactggggagtcctatgcttttgatgtctggggccaaggaaccctggtcaccgtctcctcagctagc

SEQ ID NO: 2356 - DNA, 371 bp, Artificial Sequence
  gi|Fabrus|E09_VH3-23_IGHD7-27*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagctaactggggatcctatgcttttgatgtctggggccaaggaaccctggtcaccgtctcctcagctagc

SEQ ID NO: 2357 - DNA, 377 bp, Artificial Sequence
  gi|Fabrus|A01_VH3-23_IGHD1-1*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttgtaccgtcctatgcttttgatgtctggggccaaggaaccctggtcaccgtctcctcagctagc

SEQ ID NO: 2358 - DNA, 377 bp, Artificial Sequence
  gi|Fabrus|A02_VH3-23_IGHD1-1*01>2'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttgtaccggtcctatgcttttgatgtctggggccaaggaaccctggtcaccgtctcctcagctagc

SEQ ID NO: 2359 - DNA, 377 bp, Artificial Sequence
  gi|Fabrus|A03_VH3-23_IGHD1-1*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttgtacctcctatgcttttgatgtctggggccaaggaaccctggtcaccgtctcctcagctagc

SEQ ID NO: 2360 - DNA, 377 bp, Artificial Sequence
  gi|Fabrus|A04_VH3-23_IGHD1-7*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttccagttataccgtcctatgcttttgatgtctggggccaaggaaccctggtcaccgtctcctcagctagc

SEQ ID NO: 2361 - DNA, 377 bp, Artificial Sequence
  gi|Fabrus|A05_VH3-23_IGHD1-7*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttccagttatacctcctatgcttttgatgtctggggccaaggaaccctggtcaccgtctcctcagctagc

SEQ ID NO: 2362 - DNA, 377 bp, Artificial Sequence
  gi|Fabrus|A06_VH3-23_IGHD1-14*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggttccggttataccgtcctatgcttttgatgtctggggccaaggaaccctggtcaccgtctcctcagctagc

SEQ ID NO: 2363 - DNA, 377 bp, Artificial Sequence
  gi|Fabrus|A07_VH3-23_IGHD1-14*01>2'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggttccggttataccggtcctatgcttttgatgtctggggccaaggaaccctggtcaccgtctcctcagctagc

SEQ ID NO: 2364 - DNA, 377 bp, Artificial Sequence
  gi|Fabrus|A08_VH3-23_IGHD1-14*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggttccggttatacctcctatgcttttgatgtctggggccaaggaaccctggtcaccgtctcctcagctagc

SEQ ID NO: 2365 - DNA, 377 bp, Artificial Sequence
  gi|Fabrus|A09_VH3-23_IGHD1-20*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttataccgtcctatgcttttgatgtctggggccaaggaaccctggtcaccgtctcctcagctagc

SEQ ID NO: 2366 - DNA, 377 bp, Artificial Sequence
  gi|Fabrus|A10_VH3-23_IGHD1-20*01>2'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttataccggtcctatgcttttgatgtctggggccaaggaaccctggtcaccgtctcctcagctagc

SEQ ID NO: 2367 - DNA, 377 bp, Artificial Sequence
  gi|Fabrus|A11_VH3-23_IGHD1-20*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttatacctcctatgcttttgatgtctggggccaaggaaccctggtcaccgtctcctcagctagc

SEQ ID NO: 2368 - DNA, 380 bp, Artificial Sequence
  gi|Fabrus|A12_VH3-23_IGHD1-26*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtagctcccactataccgtcctatgcttttgatgtctggggccaaggaaccctggtcaccgtctcctcagctagc

SEQ ID NO: 2369 - DNA, 380 bp, Artificial Sequence
  gi|Fabrus|B01_VH3-23_IGHD1-26*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtagctcccactatacctcctatgcttttgatgtctggggccaaggaaccctggtcaccgtctcctcagctagc

SEQ ID NO: 2370 - DNA, 389 bp, Artificial Sequence
  gi|Fabrus|B02_VH3-23_IGHD2-2*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcatagcagctggtactactacaatatcctcctatgcttttgatgtctggggccaaggaaccctggtcaccgtctcctcagctagc

SEQ ID NO: 2371 - DNA, 389 bp, Artificial Sequence
  gi|Fabrus|B03_VH3-23_IGHD2-2*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggcatagcagctggtactactacaatatctcctatgcttttgatgtctggggccaaggaaccctggtcaccgtctcctcagctagc

SEQ ID NO: 2372 - DNA, 389 bp, Artificial Sequence
  gi|Fabrus|B04_VH3-23_IGHD2-8*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcatacaccattagtacaatatcctcctatgcttttgatgtctggggccaaggaaccctggtcaccgtctcctcagctagc

SEQ ID NO: 2373 - DNA, 389 bp, Artificial Sequence
  gi|Fabrus|B05_VH3-23_IGHD2-15*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagtagcagctaccaccactacaatatcctcctatgcttttgatgtctggggccaaggaaccctggtcaccgtctcctcagctagc

SEQ ID NO: 2374 - DNA, 389 bp, Artificial Sequence
  gi|Fabrus|B06_VH3-23_IGHD2-15*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagtagcagctaccaccactacaatatctcctatgcttttgatgtctggggccaaggaaccctggtcaccgtctcctcagctagc

SEQ ID NO: 2375 - DNA, 386 bp, Artificial Sequence
  gi|Fabrus|B07_VH3-23_IGHD2-21*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggaatagcaatcaccaccacaatatgctcctatgcttttgatgtctggggccaaggaaccctggtcaccgtctcctcagctagc

SEQ ID NO: 2376 - DNA, 386 bp, Artificial Sequence
  gi|Fabrus|B08_VH3-23_IGHD2-21*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggaatagcaatcaccaccacaatatgtcctatgcttttgatgtctggggccaaggaaccctggtcaccgtctcctcagctagc

SEQ ID NO: 2377 - DNA, 389 bp, Artificial Sequence
  gi|Fabrus|B09_VH3-23_IGHD3-3*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataataaccactccaaaaatcgtaatatcctatgcttttgatgtctggggccaaggaaccctggtcaccgtctcctcagctagc

SEQ ID NO: 2378 - DNA, 389 bp, Artificial Sequence
  gi|Fabrus|B10_VH3-23_IGHD3-3*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataataaccactccaaaaatcgtaattcctatgcttttgatgtctggggccaaggaaccctggtcaccgtctcctcagctagc

SEQ ID NO: 2379 - DNA, 389 bp, Artificial Sequence
  gi|Fabrus|B11_VH3-23_IGHD3-9*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataaccagtcaaaatatcgtaatatcctatgcttttgatgtctggggccaaggaaccctggtcaccgtctcctcagctagc

SEQ ID NO: 2380 - DNA, 389 bp, Artificial Sequence
  gi|Fabrus|B12_VH3-23_IGHD3-9*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataaccagtcaaaatatcgtaattcctatgcttttgatgtctggggccaaggaaccctggtcaccgtctcctcagctagc

SEQ ID NO: 2381 - DNA, 389 bp, Artificial Sequence
  gi|Fabrus|C01_VH3-23_IGHD3-10*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataactccccgaaccatagtaatatcctatgcttttgatgtctggggccaaggaaccctggtcaccgtctcctcagctagc

SEQ ID NO: 2382 - DNA, 389 bp, Artificial Sequence
  gi|Fabrus|C02_VH3-23_IGHD3-10*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataactccccgaaccatagtaattcctatgcttttgatgtctggggccaaggaaccctggtcaccgtctcctcagctagc

SEQ ID NO: 2383 - DNA, 395 bp, Artificial Sequence
  gi|Fabrus|C03_VH3-23_IGHD3-16*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataagcataactcccccaaacgtaatcataatatcctatgcttttgatgtctggggccaaggaaccctggtcaccgtctcctcagctagc

SEQ ID NO: 2384 - DNA, 395 bp, Artificial Sequence
  gi|Fabrus|C04_VH3-23_IGHD3-16*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataagcataactcccccaaacgtaatcataattcctatgcttttgatgtctggggccaaggaaccctggtcaccgtctcctcagctagc

SEQ ID NO: 2385 - DNA, 389 bp, Artificial Sequence
  gi|Fabrus|C05_VH3-23_IGHD3-22*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtaataaccactactatcatagtaatatcctatgcttttgatgtctggggccaaggaaccctggtcaccgtctcctcagctagc

SEQ ID NO: 2386 - DNA, 374 bp, Artificial Sequence
  gi|Fabrus|C06_VH3-23_IGHD4-4*01(1)>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttactgtagtctcctatgcttttgatgtctggggccaaggaaccctggtcaccgtctcctcagctagc

SEQ ID NO: 2387 - DNA, 374 bp, Artificial Sequence
  gi|Fabrus|C07_VH3-23_IGHD4-4*01(1)>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttactgtagttcctatgcttttgatgtctggggccaaggaaccctggtcaccgtctcctcagctagc

SEQ ID NO: 2388 - DNA, 374 bp, Artificial Sequence; identical to SEQ ID NO: 2386
  gi|Fabrus|C08_VH3-23_IGHD4-11*01(1)>1'_IGHJ3*01

SEQ ID NO: 2389 - DNA, 374 bp, Artificial Sequence; identical to SEQ ID NO: 2387
  gi|Fabrus|C09_VH3-23_IGHD4-11*01(1)>3'_IGHJ3*01

SEQ ID NO: 2390 - DNA, 374 bp, Artificial Sequence
  gi|Fabrus|C10_VH3-23_IGHD4-17*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtcaccgtagtctcctatgcttttgatgtctggggccaaggaaccctggtcaccgtctcctcagctagc

SEQ ID NO: 2391 - DNA, 374 bp, Artificial Sequence
  gi|Fabrus|C11_VH3-23_IGHD4-17*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtcaccgtagttcctatgcttttgatgtctggggccaaggaaccctggtcaccgtctcctcagctagc

SEQ ID NO: 2392 - DNA, 377 bp, Artificial Sequence
  gi|Fabrus|C12_VH3-23_IGHD4-23*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagttaccaccgtagtctcctatgcttttgatgtctggggccaaggaaccctggtcaccgtctcctcagctagc

SEQ ID NO: 2393 - DNA, 377 bp, Artificial Sequence
  gi|Fabrus|D01_VH3-23_IGHD4-23*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagttaccaccgtagttcctatgcttttgatgtctggggccaaggaaccctggtcaccgtctcctcagctagc

SEQ ID NO: 2394 - DNA, 380 bp, Artificial Sequence
  gi|Fabrus|D02_VH3-23_IGHD5-5*01(2)>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaaccatagctgtatccacgtcctatgcttttgatgtctggggccaaggaaccctggtcaccgtctcctcagctagc

SEQ ID NO: 2395 - DNA, 380 bp, Artificial Sequence
  gi|Fabrus|D03_VH3-23_IGHD5-5*01(2)>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaaccatagctgtatccactcctatgcttttgatgtctggggccaaggaaccctggtcaccgtctcctcagctagc

SEQ ID NO: 2396 - DNA, 383 bp, Artificial Sequence
  gi|Fabrus|D04_VH3-23_IGHD5-12*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaatcgtagccactatatccacgtcctatgcttttgatgtctggggccaaggaaccctggtcaccgtctcctcagctagc

SEQ ID NO: 2397 - DNA, 383 bp, Artificial Sequence
  gi|Fabrus|D05_VH3-23_IGHD5-12*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaatcgtagccactatatccactcctatgcttttgatgtctggggccaaggaaccctggtcaccgtctcctcagctagc

SEQ ID NO: 2398 - DNA, 380 bp, Artificial Sequence; identical to SEQ ID NO: 2394
  gi|Fabrus|D06_VH3-23_IGHD5-18*01(2)>1'_IGHJ3*01

SEQ ID NO: 2399 - DNA, 380 bp, Artificial Sequence; identical to SEQ ID NO: 2395
  gi|Fabrus|D07_VH3-23_IGHD5-18*01(2)>3'_IGHJ3*01

SEQ ID NO: 2400 - DNA, 380 bp, Artificial Sequence
  gi|Fabrus|D08_VH3-23_IGHD5-24*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaattgtagccatctctacgtcctatgcttttgatgtctggggccaaggaaccctggtcaccgtctcctcagctagc

SEQ ID NO: 2401 - DNA, 380 bp, Artificial Sequence
  gi|Fabrus|D09_VH3-23_IGHD5-24*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaattgtagccatctctactcctatgcttttgatgtctggggccaaggaaccctggtcaccgtctcctcagctagc

SEQ ID NO: 2402 - DNA, 377 bp, Artificial Sequence
  gi|Fabrus|D10_VH3-23_IGHD6-6*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggacgagctgctatactctcctatgcttttgatgtctggggccaaggaaccctggtcaccgtctcctcagctagc

SEQ ID NO: 2403 - DNA, 377 bp, Artificial Sequence
  gi|Fabrus|D11_VH3-23_IGHD6-6*01>2'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagacgagctgctatactcgtcctatgcttttgatgtctggggccaaggaaccctggtcaccgtctcctcagctagc

SEQ ID NO: 2404 - DNA, 377 bp, Artificial Sequence
  gi|Fabrus|D12_VH3-23_IGHD6-6*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggacgagctgctatacttcctatgcttttgatgtctggggccaaggaaccctggtcaccgtctcctcagctagc

SEQ ID NO: 2405 - DNA, 380 bp, Artificial Sequence
  gi|Fabrus|E01_VH3-23_IGHD6-13*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagctgctgctataccctcctatgcttttgatgtctggggccaaggaaccctggtcaccgtctcctcagctagc

SEQ ID NO: 2406 - DNA, 380 bp, Artificial Sequence
  gi|Fabrus|E02_VH3-23_IGHD6-13*01>2'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagctgctgctatacccgtcctatgcttttgatgtctggggccaaggaaccctggtcaccgtctcctcagctagc

SEQ ID NO: 2407 - DNA, 380 bp, Artificial Sequence
  gi|Fabrus|E03_VH3-23_IGHD6-13*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagctgctgctatacctcctatgcttttgatgtctggggccaaggaaccctggtcaccgtctcctcagctagc

SEQ ID NO: 2408 - DNA, 380 bp, Artificial Sequence
  gi|Fabrus|E04_VH3-23_IGHD6-19*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagccactgctataccctcctatgcttttgatgtctggggccaaggaaccctggtcaccgtctcctcagctagc

SEQ ID NO: 2409 - DNA, 380 bp, Artificial Sequence
  gi|Fabrus|E05_VH3-23_IGHD6-19*01>2'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagccactgctatacccgtcctatgcttttgatgtctggggccaaggaaccctggtcaccgtctcctcagctagc

SEQ ID NO: 2410 - DNA, 380 bp, Artificial Sequence
  gi|Fabrus|E06_VH3-23_IGHD6-19*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagccactgctatacctcctatgcttttgatgtctggggccaaggaaccctggtcaccgtctcctcagctagc

SEQ ID NO: 2411 - DNA, 377 bp, Artificial Sequence
  gi|Fabrus|E07_VH3-23_IGHD6-25*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagccgctgctataccctcctatgcttttgatgtctggggccaaggaaccctggtcaccgtctcctcagctagc

SEQ ID NO: 2412 - DNA, 377 bp, Artificial Sequence
  gi|Fabrus|E08_VH3-23_IGHD6-25*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagccgctgctatacctcctatgcttttgatgtctggggccaaggaaccctggtcaccgtctcctcagctagc

SEQ ID NO: 2413 - DNA, 371 bp, Artificial Sequence
  gi|Fabrus|E09_VH3-23_IGHD7-27*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatccccagttaggtcctatgcttttgatgtctggggccaaggaaccctggtcaccgtctcctcagctagc

SEQ ID NO: 2414 - DNA, 371 bp, Artificial Sequence
  gi|Fabrus|E10_VH3-23_IGHD7-27*01>2'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccccagttagggtcctatgcttttgatgtctggggccaaggaaccctggtcaccgtctcctcagctagc

SEQ ID NO: 2415 - DNA, 377 bp, Artificial Sequence
  gi|Fabrus|A01_VH3-23_IGHD1-1*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtacaactggaacgacgtcctactactttgactactggggccaaggaaccctggtcaccgtctcctcagctagc

SEQ ID NO: 2416 - DNA, 377 bp, Artificial Sequence
  gi|Fabrus|A02_VH3-23_IGHD1-1*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtacaactggaacgacggtcctactactttgactactggggccaaggaaccctggtcaccgtctcctcagctagc

SEQ ID NO: 2417 - DNA, 377 bp, Artificial Sequence
  gi|Fabrus|A03_VH3-23_IGHD1-1*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtacaactggaacgactcctactactttgactactggggccaaggaaccctggtcaccgtctcctcagctagc

SEQ ID NO: 2418 - DNA, 377 bp, Artificial Sequence
  gi|Fabrus|A04_VH3-23_IGHD1-7*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaactacgtcctactactttgactactggggccaaggaaccctggtcaccgtctcctcagctagc

SEQ ID NO: 2419 - DNA, 377 bp, Artificial Sequence
  gi|Fabrus|A05_VH3-23_IGHD1-7*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaactactcctactactttgactactggggccaaggaaccctggtcaccgtctcctcagctagc

SEQ ID NO: 2420 - DNA, 377 bp, Artificial Sequence
  gi|Fabrus|A06_VH3-23_IGHD1-14*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataaccggaaccacgtcctactactttgactactggggccaaggaaccctggtcaccgtctcctcagctagc

SEQ ID NO: 2421 - DNA, 377 bp, Artificial Sequence
  gi|Fabrus|A07_VH3-23_IGHD1-14*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataaccggaaccactcctactactttgactactggggccaaggaaccctggtcaccgtctcctcagctagc

SEQ ID NO: 2422 - DNA, 377 bp, Artificial Sequence
  gi|Fabrus|A08_VH3-23_IGHD1-20*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaacgacgtcctactactttgactactggggccaaggaaccctggtcaccgtctcctcagctagc

SEQ ID NO: 2423 - DNA, 377 bp, Artificial Sequence
  gi|Fabrus|A09_VH3-23_IGHD1-20*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaacgactcctactactttgactactggggccaaggaaccctggtcaccgtctcctcagctagc

SEQ ID NO: 2424 - DNA, 380 bp, Artificial Sequence
  gi|Fabrus|A10_VH3-23_IGHD1-26*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagtgggagctactacgtcctactactttgactactggggccaaggaaccctggtcaccgtctcctcagctagc

SEQ ID NO: 2425 - DNA, 380 bp, Artificial Sequence
  gi|Fabrus|A11_VH3-23_IGHD1-26*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagtgggagctactactcctactactttgactactggggccaaggaaccctggtcaccgtctcctcagctagc

SEQ ID NO: 2426 - DNA, 389 bp, Artificial Sequence
  gi|Fabrus|A12_VH3-23_IGHD2-2*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtagtaccagctgctatgcctcctactactttgactactggggccaaggaaccctggtcaccgtctcctcagctagc

SEQ ID NO: 2427 - DNA, 389 bp, Artificial Sequence
  gi|Fabrus|B01_VH3-23_IGHD2-2*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtagtaccagctgctatgtcctactactttgactactggggccaaggaaccctggtcaccgtctcctcagctagc

SEQ ID NO: 2428 - DNA, 389 bp, Artificial Sequence
  gi|Fabrus|B02_VH3-23_IGHD2-8*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtactaatggtgtatgctatacctcctactactttgactactggggccaaggaaccctggtcaccgtctcctcagctagc

SEQ ID NO: 2429 - DNA, 389 bp, Artificial Sequence
  gi|Fabrus|B03_VH3-23_IGHD2-8*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtactaatggtgtatgctatatcctactactttgactactggggccaaggaaccctggtcaccgtctcctcagctagc

SEQ ID NO: 2430 - DNA, 389 bp, Artificial Sequence
  gi|Fabrus|B04_VH3-23_IGHD2-15*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtggtggtagctgctactcctcctactactttgactactggggccaaggaaccctggtcaccgtctcctcagctagc

SEQ ID NO: 2431 - DNA, 389 bp, Artificial Sequence
  gi|Fabrus|B05_VH3-23_IGHD2-15*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtggtggtagctgctacttcctactactttgactactggggccaaggaaccctggtcaccgtctcctcagctagc

SEQ ID NO: 2432 - DNA, 386 bp, Artificial Sequence
  gi|Fabrus|B06_VH3-23_IGHD2-21*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagcatattgtggtggtgattgctattcctcctactactttgactactggggccaaggaaccctggtcaccgtctcctcagctagc

SEQ ID NO: 2433 - DNA, 386 bp, Artificial Sequence
  gi|Fabrus|B07_VH3-23_IGHD2-21*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagcatattgtggtggtgattgctatttcctactactttgactactggggccaaggaaccctggtcaccgtctcctcagctagc

SEQ ID NO: 2434 - DNA, 389 bp, Artificial Sequence
  gi|Fabrus|B08_VH3-23_IGHD3-3*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtattacgatttttggagtggttattatactcctactactttgactactggggccaaggaaccctggtcaccgtctcctcagctagc

SEQ ID NO: 2435 - DNA, 389 bp, Artificial Sequence
  gi|Fabrus|B09_VH3-23_IGHD3-3*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatttttggagtggttattatacctcctactactttgactactggggccaaggaaccctggtcaccgtctcctcagctagc

SEQ ID NO: 2436 - DNA, 389 bp, Artificial Sequence
  gi|Fabrus|B10_VH3-23_IGHD3-3*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattacgatttttggagtggttattatatcctactactttgactactggggccaaggaaccctggtcaccgtctcctcagctagc

SEQ ID NO: 2437 - DNA, 389 bp, Artificial Sequence
  gi|Fabrus|B11_VH3-23_IGHD3-9*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatattttgactggttattataactcctactactttgactactggggccaaggaaccctggtcaccgtctcctcagctagc

SEQ ID NO: 2438 - DNA, 389 bp, Artificial Sequence
  gi|Fabrus|B12_VH3-23_IGHD3-10*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatggttcggggagttattataactcctactactttgactactggggccaaggaaccctggtcaccgtctcctcagctagc

SEQ ID NO: 2439 - DNA, 389 bp, Artificial Sequence
  gi|Fabrus|C01_VH3-23_IGHD3-10*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatggttcggggagttattatatcctactactttgactactggggccaaggaaccctggtcaccgtctcctcagctagc

SEQ ID NO: 2440 - DNA, 395 bp, Artificial Sequence
  gi|Fabrus|C02_VH3-23_IGHD3-16*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattatgattacgtttgggggagttatgcttatacctcctactactttgactactggggccaaggaaccctggtcaccgtctcctcagctagc

SEQ ID NO: 2441 - DNA, 395 bp, Artificial Sequence
  gi|Fabrus|C03_VH3-23_IGHD3-16*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattatgattacgtttgggggagttatgcttatatcctactactttgactactggggccaaggaaccctggtcaccgtctcctcagctagc

SEQ ID NO: 2442 - DNA, 389 bp, Artificial Sequence
  gi|Fabrus|C04_VH3-23_IGHD3-22*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatgatagtagtggttattactactcctactactttgactactggggccaaggaaccctggtcaccgtctcctcagctagc

SEQ ID NO: 2443 - DNA, 389 bp, Artificial Sequence
  gi|Fabrus|C05_VH3-23_IGHD3-22*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatgatagtagtggttattacttcctactactttgactactggggccaaggaaccctggtcaccgtctcctcagctagc

SEQ ID NO: 2444 - DNA, 374 bp, Artificial Sequence
  gi|Fabrus|C06_VH3-23_IGHD4-4*01(1)>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacagtaactactcctactactttgactactggggccaaggaaccctggtcaccgtctcctcagctagc

SEQ ID NO: 2445 - DNA, 374 bp, Artificial Sequence
  gi|Fabrus|C07_VH3-23_IGHD4-4*01(1)>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacagtaacttcctactactttgactactggggccaaggaaccctggtcaccgtctcctcagctagc

SEQ ID NO: 2446 - DNA, 374 bp, Artificial Sequence; identical to SEQ ID NO: 2444
  gi|Fabrus|C08_VH3-23_IGHD4-11*01(1)>2_IGHJ4*01

SEQ ID NO: 2447 - DNA, 374 bp, Artificial Sequence; identical to SEQ ID NO: 2445
  gi|Fabrus|C09_VH3-23_IGHD4-11*01(1)>3_IGHJ4*01

SEQ ID NO: 2448 - DNA, 374 bp, Artificial Sequence
  gi|Fabrus|C10_VH3-23_IGHD4-17*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtgactactcctactactttgactactggggccaaggaaccctggtcaccgtctcctcagctagc

SEQ ID NO: 2449 - DNA, 374 bp, Artificial Sequence
  gi|Fabrus|C11_VH3-23_IGHD4-17*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtgacttcctactactttgactactggggccaaggaaccctggtcaccgtctcctcagctagc

SEQ ID NO: 2450 - DNA, 377 bp, Artificial Sequence
  gi|Fabrus|C12_VH3-23_IGHD4-23*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtggtaactcctcctactactttgactactggggccaaggaaccctggtcaccgtctcctcagctagc

SEQ ID NO: 2451 - DNA, 377 bp, Artificial Sequence
  gi|Fabrus|D01_VH3-23_IGHD4-23*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtggtaacttcctactactttgactactggggccaaggaaccctggtcaccgtctcctcagctagc

SEQ ID NO: 2452 - DNA, 380 bp, Artificial Sequence
  gi|Fabrus|D02_VH3-23_IGHD5-5*01(2)>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatacagctatggttacgtcctactactttgactactggggccaaggaaccctggtcaccgtctcctcagctagc

SEQ ID NO: 2453 - DNA, 380 bp, Artificial Sequence
  gi|Fabrus|D03_VH3-23_IGHD5-5*01(2)>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggatacagctatggttacggtcctactactttgactactggggccaaggaaccctggtcaccgtctcctcagctagc

SEQ ID NO: 2454 - DNA, 380 bp, Artificial Sequence
  gi|Fabrus|D04_VH3-23_IGHD5-5*01(2)>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatacagctatggttactcctactactttgactactggggccaaggaaccctggtcaccgtctcctcagctagc

SEQ ID NO: 2455 - DNA, 383 bp, Artificial Sequence
  gi|Fabrus|D05_VH3-23_IGHD5-12*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatatagtggctacgattacgtcctactactttgactactggggccaaggaaccctggtcaccgtctcctcagctagc

SEQ ID NO: 2456 - DNA, 383 bp, Artificial Sequence
  gi|Fabrus|D06_VH3-23_IGHD5-12*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatatagtggctacgattactcctactactttgactactggggccaaggaaccctggtcaccgtctcctcagctagc

SEQ ID NO: 2457 - DNA, 380 bp, Artificial Sequence; identical to SEQ ID NO: 2452
  gi|Fabrus|D07_VH3-23_IGHD5-18*01(2)>1_IGHJ4*01

SEQ ID NO: 2458 - DNA, 380 bp, Artificial Sequence; identical to SEQ ID NO: 2453
  gi|Fabrus|D08_VH3-23_IGHD5-18*01(2)>2_IGHJ4*01

SEQ ID NO: 2459 - DNA, 380 bp, Artificial Sequence; identical to SEQ ID NO: 2454
  gi|Fabrus|D09_VH3-23_IGHD5-18*01(2)>3_IGHJ4*01

SEQ ID NO: 2460 - DNA, 380 bp, Artificial Sequence
  gi|Fabrus|D10_VH3-23_IGHD5-24*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagagatggctacaattacgtcctactactttgactactggggccaaggaaccctggtcaccgtctcctcagctagc

SEQ ID NO: 2461 - DNA, 380 bp, Artificial Sequence
  gi|Fabrus|D11_VH3-23_IGHD5-24*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagagatggctacaattactcctactactttgactactggggccaaggaaccctggtcaccgtctcctcagctagc

SEQ ID NO: 2462 - DNA, 377 bp, Artificial Sequence
  gi|Fabrus|D12_VH3-23_IGHD6-6*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagtatagcagctcgtcctcctactactttgactactggggccaaggaaccctggtcaccgtctcctcagctagc

SEQ ID NO: 2463 - DNA, 377 bp, Artificial Sequence
  gi|Fabrus|E01_VH3-23_IGHD6-6*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaagtatagcagctcgtccgtcctactactttgactactggggccaaggaaccctggtcaccgtctcctcagctagc

SEQ ID NO: 2464 - DNA, 380 bp, Artificial Sequence
  gi|Fabrus|E02_VH3-23_IGHD6-13*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcagctggtactcctactactttgactactggggccaaggaaccctggtcaccgtctcctcagctagc

SEQ ID NO: 2465 - DNA, 380 bp, Artificial Sequence
  gi|Fabrus|E03_VH3-23_IGHD6-13*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcagctggtacgtcctactactttgactactggggccaaggaaccctggtcaccgtctcctcagctagc

SEQ ID NO: 2466 - DNA, 380 bp, Artificial Sequence
  gi|Fabrus|E04_VH3-23_IGHD6-19*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagtggctggtactcctactactttgactactggggccaaggaaccctggtcaccgtctcctcagctagc

SEQ ID NO: 2467 - DNA, 380 bp, Artificial Sequence
  gi|Fabrus|E05_VH3-23_IGHD6-19*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagtggctggtacgtcctactactttgactactggggccaaggaaccctggtcaccgtctcctcagctagc

SEQ ID NO: 2468 - DNA, 377 bp, Artificial Sequence
  gi|Fabrus|E06_VH3-23_IGHD6-25*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcggctactcctactactttgactactggggccaaggaaccctggtcaccgtctcctcagctagc

SEQ ID NO: 2469 - DNA, 377 bp, Artificial Sequence
  gi|Fabrus|E07_VH3-23_IGHD6-25*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcggctacgtcctactactttgactactggggccaaggaaccctggtcaccgtctcctcagctagc

SEQ ID NO: 2470 - DNA, 371 bp, Artificial Sequence
  gi|Fabrus|E08_VH3-23_IGHD7-27*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaactaactggggagtcctactactttgactactggggccaaggaaccctggtcaccgtctcctcagctagc

SEQ ID NO: 2471 - DNA, 371 bp, Artificial Sequence
  gi|Fabrus|E09_VH3-23_IGHD7-27*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagctaactggggatcctactactttgactactggggccaaggaaccctggtcaccgtctcctcagctagc

SEQ ID NO: 2472 - DNA, 377 bp, Artificial Sequence
  gi|Fabrus|A01_VH3-23_IGHD1-1*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttgtaccgtcctactactttgactactggggccaaggaaccctggtcaccgtctcctcagctagc

SEQ ID NO: 2473 - DNA, 377 bp, Artificial Sequence
  gi|Fabrus|A02_VH3-23_IGHD1-1*01>2'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttgtaccggtcctactactttgactactggggccaaggaaccctggtcaccgtctcctcagctagc

SEQ ID NO: 2474 - DNA, 377 bp, Artificial Sequence
  gi|Fabrus|A03_VH3-23_IGHD1-1*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttgtacctcctactactttgactactggggccaaggaaccctggtcaccgtctcctcagctagc

SEQ ID NO: 2475 - DNA, 377 bp, Artificial Sequence
  gi|Fabrus|A04_VH3-23_IGHD1-7*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttccagttataccgtcctactactttgactactggggccaaggaaccctggtcaccgtctcctcagctagc

SEQ ID NO: 2476 - DNA, 377 bp, Artificial Sequence
  gi|Fabrus|A05_VH3-23_IGHD1-7*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttccagttatacctcctactactttgactactggggccaaggaaccctggtcaccgtctcctcagctagc

SEQ ID NO: 2477 - DNA, 377 bp, Artificial Sequence
  gi|Fabrus|A06_VH3-23_IGHD1-14*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggttccggttataccgtcctactactttgactactggggccaaggaaccctggtcaccgtctcctcagctagc

SEQ ID NO: 2478 - DNA, 377 bp, Artificial Sequence
  gi|Fabrus|A07_VH3-23_IGHD1-14*01>2'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggttccggttataccggtcctactactttgactactggggccaaggaaccctggtcaccgtctcctcagctagc

SEQ ID NO: 2479 - DNA, 377 bp, Artificial Sequence
  gi|Fabrus|A08_VH3-23_IGHD1-14*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggttccggttatacctcctactactttgactactggggccaaggaaccctggtcaccgtctcctcagctagc

SEQ ID NO: 2480 - DNA, 377 bp, Artificial Sequence
  gi|Fabrus|A09_VH3-23_IGHD1-20*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttataccgtcctactactttgactactggggccaaggaaccctggtcaccgtctcctcagctagc

SEQ ID NO: 2481 - DNA, 377 bp, Artificial Sequence
  gi|Fabrus|A10_VH3-23_IGHD1-20*01>2'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttataccggtcctactactttgactactggggccaaggaaccctggtcaccgtctcctcagctagc

SEQ ID NO: 2482 - DNA, 377 bp, Artificial Sequence
  gi|Fabrus|A11_VH3-23_IGHD1-20*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttatacctcctactactttgactactggggccaaggaaccctggtcaccgtctcctcagctagc

SEQ ID NO: 2483 - DNA, 380 bp, Artificial Sequence
  gi|Fabrus|A12_VH3-23_IGHD1-26*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtagctcccactataccgtcctactactttgactactggggccaaggaaccctggtcaccgtctcctcagctagc

SEQ ID NO: 2484 - DNA, 380 bp, Artificial Sequence
  gi|Fabrus|B01_VH3-23_IGHD1-26*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtagctcccactatacctcctactactttgactactggggccaaggaaccctggtcaccgtctcctcagctagc

SEQ ID NO: 2485 - DNA, 389 bp, Artificial Sequence
  gi|Fabrus|B02_VH3-23_IGHD2-2*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcatagcagctggtactactacaatatcctcctactactttgactactggggccaaggaaccctggtcaccgtctcctcagctagc

SEQ ID NO: 2486 - DNA, 389 bp, Artificial Sequence
  gi|Fabrus|B03_VH3-23_IGHD2-2*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggcatagcagctggtactactacaatatctcctactactttgactactggggccaaggaaccctggtcaccgtctcctcagctagc

SEQ ID NO: 2487 - DNA, 389 bp, Artificial Sequence
  gi|Fabrus|B04_VH3-23_IGHD2-8*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcatacaccattagtacaatatcctcctactactttgactactggggccaaggaaccctggtcaccgtctcctcagctagc

SEQ ID NO: 2488 - DNA, 389 bp, Artificial Sequence
  gi|Fabrus|B05_VH3-23_IGHD2-15*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagtagcagctaccaccactacaatatcctcctactactttgactactggggccaaggaaccctggtcaccgtctcctcagctagc

SEQ ID NO: 2489 - DNA, 389 bp, Artificial Sequence
  gi|Fabrus|B06_VH3-23_IGHD2-15*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagtagcagctaccaccactacaatatctcctactactttgactactggggccaaggaaccctggtcaccgtctcctcagctagc

SEQ ID NO: 2490 - DNA, 386 bp, Artificial Sequence
  gi|Fabrus|B07_VH3-23_IGHD2-21*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggaatagcaatcaccaccacaatatgctcctactactttgactactggggccaaggaaccctggtcaccgtctcctcagctagc

SEQ ID NO: 2491 - DNA, 386 bp, Artificial Sequence
  gi|Fabrus|B08_VH3-23_IGHD2-21*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggaatagcaatcaccaccacaatatgtcctactactttgactactggggccaaggaaccctggtcaccgtctcctcagctagc

SEQ ID NO: 2492 - DNA, 389 bp, Artificial Sequence
  gi|Fabrus|B09_VH3-23_IGHD3-3*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataataaccactccaaaaatcgtaatatcctactactttgactactggggccaaggaaccctggtcaccgtctcctcagctagc

SEQ ID NO: 2493 - DNA, 389 bp, Artificial Sequence
  gi|Fabrus|B10_VH3-23_IGHD3-3*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataataaccactccaaaaatcgtaattcctactactttgactactggggccaaggaaccctggtcaccgtctcctcagctagc

SEQ ID NO: 2494 - DNA, 389 bp, Artificial Sequence
  gi|Fabrus|B11_VH3-23_IGHD3-9*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataaccagtcaaaatatcgtaatatcctactactttgactactggggccaaggaaccctggtcaccgtctcctcagctagc

SEQ ID NO: 2495 - DNA, 389 bp, Artificial Sequence
  gi|Fabrus|B12_VH3-23_IGHD3-9*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataaccagtcaaaatatcgtaattcctactactttgactactggggccaaggaaccctggtcaccgtctcctcagctagc

SEQ ID NO: 2496 - DNA, 389 bp, Artificial Sequence
  gi|Fabrus|C01_VH3-23_IGHD3-10*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataactccccgaaccatagtaatatcctactactttgactactggggccaaggaaccctggtcaccgtctcctcagctagc

SEQ ID NO: 2497 - DNA, 389 bp, Artificial Sequence
  gi|Fabrus|C02_VH3-23_IGHD3-10*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataactccccgaaccatagtaattcctactactttgactactggggccaaggaaccctggtcaccgtctcctcagctagc

SEQ ID NO: 2498 - DNA, 395 bp, Artificial Sequence
  gi|Fabrus|C03_VH3-23_IGHD3-16*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataagcataactcccccaaacgtaatcataatatcctactactttgactactggggccaaggaaccctggtcaccgtctcctcagctagc

SEQ ID NO: 2499 - DNA, 395 bp, Artificial Sequence
  gi|Fabrus|C04_VH3-23_IGHD3-16*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataagcataactcccccaaacgtaatcataattcctactactttgactactggggccaaggaaccctggtcaccgtctcctcagctagc

SEQ ID NO: 2500 - DNA, 389 bp, Artificial Sequence
  gi|Fabrus|C05_VH3-23_IGHD3-22*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtaataaccactactatcatagtaatatcctactactttgactactggggccaaggaaccctggtcaccgtctcctcagctagc

SEQ ID NO: 2501 - DNA, 374 bp, Artificial Sequence
  gi|Fabrus|C06_VH3-23_IGHD4-4*01(1)>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttactgtagtctcctactactttgactactggggccaaggaaccctggtcaccgtctcctcagctagc

SEQ ID NO: 2502 - DNA, 374 bp, Artificial Sequence
  gi|Fabrus|C07_VH3-23_IGHD4-4*01(1)>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttactgtagttcctactactttgactactggggccaaggaaccctggtcaccgtctcctcagctagc

SEQ ID NO: 2503 - DNA, 374 bp, Artificial Sequence; identical to SEQ ID NO: 2501
  gi|Fabrus|C08_VH3-23_IGHD4-11*01(1)>1'_IGHJ4*01

SEQ ID NO: 2504 - DNA, 374 bp, Artificial Sequence; identical to SEQ ID NO: 2502
  gi|Fabrus|C09_VH3-23_IGHD4-11*01(1)>3'_IGHJ4*01

SEQ ID NO: 2505 - DNA, 374 bp, Artificial Sequence
  gi|Fabrus|C10_VH3-23_IGHD4-17*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtcaccgtagtctcctactactttgactactggggccaaggaaccctggtcaccgtctcctcagctagc

SEQ ID NO: 2506 - DNA, 374 bp, Artificial Sequence
  gi|Fabrus|C11_VH3-23_IGHD4-17*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtcaccgtagttcctactactttgactactggggccaaggaaccctggtcaccgtctcctcagctagc

SEQ ID NO: 2507 - DNA, 377 bp, Artificial Sequence
  gi|Fabrus|C12_VH3-23_IGHD4-23*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagttaccaccgtagtctcctactactttgactactggggccaaggaaccctggtcaccgtctcctcagctagc

SEQ ID NO: 2508 - DNA, 377 bp, Artificial Sequence
  gi|Fabrus|D01_VH3-23_IGHD4-23*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagttaccaccgtagttcctactactttgactactggggccaaggaaccctggtcaccgtctcctcagctagc

SEQ ID NO: 2509 - DNA, 380 bp, Artificial Sequence
  gi|Fabrus|D02_VH3-23_IGHD5-5*01(2)>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaaccatagctgtatccacgtcctactactttgactactggggccaaggaaccctggtcaccgtctcctcagctagc

SEQ ID NO: 2510 - DNA, 380 bp, Artificial Sequence
  gi|Fabrus|D03_VH3-23_IGHD5-5*01(2)>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaaccatagctgtatccactcctactactttgactactggggccaaggaaccctggtcaccgtctcctcagctagc

SEQ ID NO: 2511 - DNA, 383 bp, Artificial Sequence
  gi|Fabrus|D04_VH3-23_IGHD5-12*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaatcgtagccactatatccacgtcctactactttgactactggggccaaggaaccctggtcaccgtctcctcagctagc

SEQ ID NO: 2512 - DNA, 383 bp, Artificial Sequence
  gi|Fabrus|D05_VH3-23_IGHD5-12*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaatcgtagccactatatccactcctactactttgactactggggccaaggaaccctggtcaccgtctcctcagctagc

SEQ ID NO: 2513 - DNA, 380 bp, Artificial Sequence; identical to SEQ ID NO: 2509
  gi|Fabrus|D06_VH3-23_IGHD5-18*01(2)>1'_IGHJ4*01

SEQ ID NO: 2514 - DNA, 380 bp, Artificial Sequence; identical to SEQ ID NO: 2510
  gi|Fabrus|D07_VH3-23_IGHD5-18*01(2)>3'_IGHJ4*01

SEQ ID NO: 2515 - DNA, 380 bp, Artificial Sequence
  gi|Fabrus|D08_VH3-23_IGHD5-24*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaattgtagccatctctacgtcctactactttgactactggggccaaggaaccctggtcaccgtctcctcagctagc

SEQ ID NO: 2516 - DNA, 380 bp, Artificial Sequence
  gi|Fabrus|D09_VH3-23_IGHD5-24*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaattgtagccatctctactcctactactttgactactggggccaaggaaccctggtcaccgtctcctcagctagc

SEQ ID NO: 2517 - DNA, 377 bp, Artificial Sequence
  gi|Fabrus|D10_VH3-23_IGHD6-6*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggacgagctgctatactctcctactactttgactactggggccaaggaaccctggtcaccgtctcctcagctagc

SEQ ID NO: 2518 - DNA, 377 bp, Artificial Sequence
  gi|Fabrus|D11_VH3-23_IGHD6-6*01>2'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagacgagctgctatactcgtcctactactttgactactggggccaaggaaccctggtcaccgtctcctcagctagc

SEQ ID NO: 2519 - DNA, 377 bp, Artificial Sequence
  gi|Fabrus|D12_VH3-23_IGHD6-6*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggacgagctgctatacttcctactactttgactactggggccaaggaaccctggtcaccgtctcctcagctagc

SEQ ID NO: 2520 - DNA, 380 bp, Artificial Sequence
  gi|Fabrus|E01_VH3-23_IGHD6-13*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagctgctgctataccctcctactactttgactactggggccaaggaaccctggtcaccgtctcctcagctagc

SEQ ID NO: 2521 - DNA, 380 bp, Artificial Sequence
  gi|Fabrus|E02_VH3-23_IGHD6-13*01>2'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagctgctgctatacccgtcctactactttgactactggggccaaggaaccctggtcaccgtctcctcagctagc

SEQ ID NO: 2522 - DNA, 380 bp, Artificial Sequence
  gi|Fabrus|E03_VH3-23_IGHD6-13*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagctgctgctatacctcctactactttgactactggggccaaggaaccctggtcaccgtctcctcagctagc

SEQ ID NO: 2523 - DNA, 380 bp, Artificial Sequence
  gi|Fabrus|E04_VH3-23_IGHD6-19*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagccactgctataccctcctactactttgactactggggccaaggaaccctggtcaccgtctcctcagctagc

SEQ ID NO: 2524 - DNA, 380 bp, Artificial Sequence
  gi|Fabrus|E05_VH3-23_IGHD6-19*01>2'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagccactgctatacccgtcctactactttgactactggggccaaggaaccctggtcaccgtctcctcagctagc

SEQ ID NO: 2525 - DNA, 380 bp, Artificial Sequence
  gi|Fabrus|E06_VH3-23_IGHD6-19*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagccactgctatacctcctactactttgactactggggccaaggaaccctggtcaccgtctcctcagctagc

SEQ ID NO: 2526 - DNA, 377 bp, Artificial Sequence
  gi|Fabrus|E07_VH3-23_IGHD6-25*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagccgctgctataccctcctactactttgactactggggccaaggaaccctggtcaccgtctcctcagctagc

SEQ ID NO: 2527 - DNA, 377 bp, Artificial Sequence
  gi|Fabrus|E08_VH3-23_IGHD6-25*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagccgctgctatacctcctactactttgactactggggccaaggaaccctggtcaccgtctcctcagctagc

SEQ ID NO: 2528 - DNA, 371 bp, Artificial Sequence
  gi|Fabrus|E09_VH3-23_IGHD7-27*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatccccagttaggtcctactactttgactactggggccaaggaaccctggtcaccgtctcctcagctagc

SEQ ID NO: 2529 - DNA, 371 bp, Artificial Sequence
  gi|Fabrus|E10_VH3-23_IGHD7-27*01>2'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccccagttagggtcctactactttgactactggggccaaggaaccctggtcaccgtctcctcagctagc

SEQ ID NO: 2530 - DNA, 380 bp, Artificial Sequence
  gi|Fabrus|A01_VH3-23_IGHD1-1*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtacaactggaacgacgtcctacaactggttcgactactggggccaaggaaccctggtcaccgtctcctcagctagc

SEQ ID NO: 2531 - DNA, 380 bp, Artificial Sequence
  gi|Fabrus|A02_VH3-23_IGHD1-1*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtacaactggaacgacggtcctacaactggttcgactactggggccaaggaaccctggtcaccgtctcctcagctagc

SEQ ID NO: 2532 - DNA, 380 bp, Artificial Sequence
  gi|Fabrus|A03_VH3-23_IGHD1-1*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtacaactggaacgactcctacaactggttcgactactggggccaaggaaccctggtcaccgtctcctcagctagc

SEQ ID NO: 2533 - DNA, 380 bp, Artificial Sequence
  gi|Fabrus|A04_VH3-23_IGHD1-7*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaactacgtcctacaactggttcgactactggggccaaggaaccctggtcaccgtctcctcagctagc

SEQ ID NO: 2534 - DNA, 380 bp, Artificial Sequence
  gi|Fabrus|A05_VH3-23_IGHD1-7*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaactactcctacaactggttcgactactggggccaaggaaccctggtcaccgtctcctcagctagc

SEQ ID NO: 2535 - DNA, 380 bp, Artificial Sequence
  gi|Fabrus|A06_VH3-23_IGHD1-14*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataaccggaaccacgtcctacaactggttcgactactggggccaaggaaccctggtcaccgtctcctcagctagc

SEQ ID NO: 2536 - DNA, 380 bp, Artificial Sequence
  gi|Fabrus|A07_VH3-23_IGHD1-14*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataaccggaaccactcctacaactggttcgactactggggccaaggaaccctggtcaccgtctcctcagctagc

SEQ ID NO: 2537 - DNA, 380 bp, Artificial Sequence
  gi|Fabrus|A08_VH3-23_IGHD1-20*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaacgacgtcctacaactggttcgactactggggccaaggaaccctggtcaccgtctcctcagctagc

SEQ ID NO: 2538 - DNA, 380 bp, Artificial Sequence
  gi|Fabrus|A09_VH3-23_IGHD1-20*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaacgactcctacaactggttcgactactggggccaaggaaccctggtcaccgtctcctcagctagc

SEQ ID NO: 2539 - DNA, 383 bp, Artificial Sequence
  gi|Fabrus|A10_VH3-23_IGHD1-26*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagtgggagctactacgtcctacaactggttcgactactggggccaaggaaccctggtcaccgtctcctcagctagc

SEQ ID NO: 2540 - DNA, 383 bp, Artificial Sequence
  gi|Fabrus|A11_VH3-23_IGHD1-26*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagtgggagctactactcctacaactggttcgactactggggccaaggaaccctggtcaccgtctcctcagctagc

SEQ ID NO: 2541 - DNA, 392 bp, Artificial Sequence
  gi|Fabrus|A12_VH3-23_IGHD2-2*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtagtaccagctgctatgcctcctacaactggttcgactactggggccaaggaaccctggtcaccgtctcctcagctagc

SEQ ID NO: 2542 - DNA, 392 bp, Artificial Sequence
  gi|Fabrus|B01_VH3-23_IGHD2-2*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtagtaccagctgctatgtcctacaactggttcgactactggggccaaggaaccctggtcaccgtctcctcagctagc

SEQ ID NO: 2543 - DNA, 392 bp, Artificial Sequence
  gi|Fabrus|B02_VH3-23_IGHD2-8*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtactaatggtgtatgctatacctcctacaactggttcgactactggggccaaggaaccctggtcaccgtctcctcagctagc

SEQ ID NO: 2544 - DNA, 392 bp, Artificial Sequence
  gi|Fabrus|B03_VH3-23_IGHD2-8*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtactaatggtgtatgctatatcctacaactggttcgactactggggccaaggaaccctggtcaccgtctcctcagctagc

SEQ ID NO: 2545 - DNA, 392 bp, Artificial Sequence
  gi|Fabrus|B04_VH3-23_IGHD2-15*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtggtggtagctgctactcctcctacaactggttcgactactggggccaaggaaccctggtcaccgtctcctcagctagc

SEQ ID NO: 2546 - DNA, 392 bp, Artificial Sequence
  gi|Fabrus|B05_VH3-23_IGHD2-15*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtggtggtagctgctacttcctacaactggttcgactactggggccaaggaaccctggtcaccgtctcctcagctagc

SEQ ID NO: 2547 - DNA, 389 bp, Artificial Sequence
  gi|Fabrus|B06_VH3-23_IGHD2-21*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagcatattgtggtggtgattgctattcctcctacaactggttcgactactggggccaaggaaccctggtcaccgtctcctcagctagc

SEQ ID NO: 2548 - DNA, 389 bp, Artificial Sequence
  gi|Fabrus|B07_VH3-23_IGHD2-21*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagcatattgtggtggtgattgctatttcctacaactggttcgactactggggccaaggaaccctggtcaccgtctcctcagctagc

SEQ ID NO: 2549 - DNA, 392 bp, Artificial Sequence
  gi|Fabrus|B08_VH3-23_IGHD3-3*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtattacgatttttggagtggttattatactcctacaactggttcgactactggggccaaggaaccctggtcaccgtctcctcagctagc

SEQ ID NO: 2550 - DNA, 392 bp, Artificial Sequence
  gi|Fabrus|B09_VH3-23_IGHD3-3*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatttttggagtggttattatacctcctacaactggttcgactactggggccaaggaaccctggtcaccgtctcctcagctagc

SEQ ID NO: 2551 - DNA, 392 bp, Artificial Sequence
  gi|Fabrus|B10_VH3-23_IGHD3-3*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattacgatttttggagtggttattatatcctacaactggttcgactactggggccaaggaaccctggtcaccgtctcctcagctagc

SEQ ID NO: 2552 - DNA, 392 bp, Artificial Sequence
  gi|Fabrus|B11_VH3-23_IGHD3-9*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatattttgactggttattataactcctacaactggttcgactactggggccaaggaaccctggtcaccgtctcctcagctagc

SEQ ID NO: 2553 - DNA, 392 bp, Artificial Sequence
  gi|Fabrus|B12_VH3-23_IGHD3-10*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatggttcggggagttattataactcctacaactggttcgactactggggccaaggaaccctggtcaccgtctcctcagctagc

SEQ ID NO: 2554 - DNA, 392 bp, Artificial Sequence
  gi|Fabrus|C01_VH3-23_IGHD3-10*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatggttcggggagttattatatcctacaactggttcgactactggggccaaggaaccctggtcaccgtctcctcagctagc

SEQ ID NO: 2555 - DNA, 398 bp, Artificial Sequence
  gi|Fabrus|C02_VH3-23_IGHD3-16*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattatgattacgtttgggggagttatgcttatacctcctacaactggttcgactactggggccaaggaaccctggtcaccgtctcctcagctagc

SEQ ID NO: 2556 - DNA, 398 bp, Artificial Sequence
  gi|Fabrus|C03_VH3-23_IGHD3-16*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattatgattacgtttgggggagttatgcttatatcctacaactggttcgactactggggccaaggaaccctggtcaccgtctcctcagctagc

SEQ ID NO: 2557 - DNA, 392 bp, Artificial Sequence
  gi|Fabrus|C04_VH3-23_IGHD3-22*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatgatagtagtggttattactactcctacaactggttcgactactggggccaaggaaccctggtcaccgtctcctcagctagc

SEQ ID NO: 2558 - DNA, 392 bp, Artificial Sequence
  gi|Fabrus|C05_VH3-23_IGHD3-22*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatgatagtagtggttattacttcctacaactggttcgactactggggccaaggaaccctggtcaccgtctcctcagctagc

SEQ ID NO: 2559 - DNA, 377 bp, Artificial Sequence
  gi|Fabrus|C06_VH3-23_IGHD4-4*01(1)>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacagtaactactcctacaactggttcgactactggggccaaggaaccctggtcaccgtctcctcagctagc

SEQ ID NO: 2560 - DNA, 377 bp, Artificial Sequence
  gi|Fabrus|C07_VH3-23_IGHD4-4*01(1)>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacagtaacttcctacaactggttcgactactggggccaaggaaccctggtcaccgtctcctcagctagc

SEQ ID NO: 2561 - DNA, 377 bp, Artificial Sequence; identical to SEQ ID NO: 2559
  gi|Fabrus|C08_VH3-23_IGHD4-11*01(1)>2_IGHJ5*01

SEQ ID NO: 2562 - DNA, 377 bp, Artificial Sequence; identical to SEQ ID NO: 2560
  gi|Fabrus|C09_VH3-23_IGHD4-11*01(1)>3_IGHJ5*01

SEQ ID NO: 2563 - DNA, 377 bp, Artificial Sequence
  gi|Fabrus|C10_VH3-23_IGHD4-17*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtgactactcctacaactggttcgactactggggccaaggaaccctggtcaccgtctcctcagctagc

SEQ ID NO: 2564 - DNA, 377 bp, Artificial Sequence
  gi|Fabrus|C11_VH3-23_IGHD4-17*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtgacttcctacaactggttcgactactggggccaaggaaccctggtcaccgtctcctcagctagc

SEQ ID NO: 2565 - DNA, 380 bp, Artificial Sequence
  gi|Fabrus|C12_VH3-23_IGHD4-23*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtggtaactcctcctacaactggttcgactactggggccaaggaaccctggtcaccgtctcctcagctagc

SEQ ID NO: 2566 - DNA, 380 bp, Artificial Sequence
  gi|Fabrus|D01_VH3-23_IGHD4-23*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtggtaacttcctacaactggttcgactactggggccaaggaaccctggtcaccgtctcctcagctagc

SEQ ID NO: 2567 - DNA, 383 bp, Artificial Sequence
  gi|Fabrus|D02_VH3-23_IGHD5-5*01(2)>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatacagctatggttacgtcctacaactggttcgactactggggccaaggaaccctggtcaccgtctcctcagctagc

SEQ ID NO: 2568 - DNA, 383 bp, Artificial Sequence
  gi|Fabrus|D03_VH3-23_IGHD5-5*01(2)>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggatacagctatggttacggtcctacaactggttcgactactggggccaaggaaccctggtcaccgtctcctcagctagc

SEQ ID NO: 2569 - DNA, 383 bp, Artificial Sequence
  gi|Fabrus|D04_VH3-23_IGHD5-5*01(2)>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatacagctatggttactcctacaactggttcgactactggggccaaggaaccctggtcaccgtctcctcagctagc

SEQ ID NO: 2570 - DNA, 386 bp, Artificial Sequence
  gi|Fabrus|D05_VH3-23_IGHD5-12*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatatagtggctacgattacgtcctacaactggttcgactactggggccaaggaaccctggtcaccgtctcctcagctagc

SEQ ID NO: 2571 - DNA, 386 bp, Artificial Sequence
  gi|Fabrus|D06_VH3-23_IGHD5-12*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatatagtggctacgattactcctacaactggttcgactactggggccaaggaaccctggtcaccgtctcctcagctagc

SEQ ID NO: 2572 - DNA, 383 bp, Artificial Sequence; identical to SEQ ID NO: 2567
  gi|Fabrus|D07_VH3-23_IGHD5-18*01(2)>1_IGHJ5*01

SEQ ID NO: 2573 - DNA, 383 bp, Artificial Sequence; identical to SEQ ID NO: 2568
  gi|Fabrus|D08_VH3-23_IGHD5-18*01(2)>2_IGHJ5*01

SEQ ID NO: 2574 - DNA, 383 bp, Artificial Sequence; identical to SEQ ID NO: 2569
  gi|Fabrus|D09_VH3-23_IGHD5-18*01(2)>3_IGHJ5*01

SEQ ID NO: 2575 - DNA, 383 bp, Artificial Sequence
  gi|Fabrus|D10_VH3-23_IGHD5-24*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagagatggctacaattacgtcctacaactggttcgactactggggccaaggaaccctggtcaccgtctcctcagctagc

SEQ ID NO: 2576 - DNA, 383 bp, Artificial Sequence
  gi|Fabrus|D11_VH3-23_IGHD5-24*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagagatggctacaattactcctacaactggttcgactactggggccaaggaaccctggtcaccgtctcctcagctagc

SEQ ID NO: 2577 - DNA, 380 bp, Artificial Sequence
  gi|Fabrus|D12_VH3-23_IGHD6-6*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagtatagcagctcgtcctcctacaactggttcgactactggggccaaggaaccctggtcaccgtctcctcagctagc

SEQ ID NO: 2578 - DNA, 380 bp, Artificial Sequence
  gi|Fabrus|E01_VH3-23_IGHD6-6*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaagtatagcagctcgtccgtcctacaactggttcgactactggggccaaggaaccctggtcaccgtctcctcagctagc

SEQ ID NO: 2579 - DNA, 383 bp, Artificial Sequence
  gi|Fabrus|E02_VH3-23_IGHD6-13*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcagctggtactcctacaactggttcgactactggggccaaggaaccctggtcaccgtctcctcagctagc

SEQ ID NO: 2580 - DNA, 383 bp, Artificial Sequence
  gi|Fabrus|E03_VH3-23_IGHD6-13*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcagctggtacgtcctacaactggttcgactactggggccaaggaaccctggtcaccgtctcctcagctagc

SEQ ID NO: 2581 - DNA, 383 bp, Artificial Sequence
  gi|Fabrus|E04_VH3-23_IGHD6-19*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagtggctggtactcctacaactggttcgactactggggccaaggaaccctggtcaccgtctcctcagctagc

SEQ ID NO: 2582 - DNA, 383 bp, Artificial Sequence
  gi|Fabrus|E05_VH3-23_IGHD6-19*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagtggctggtacgtcctacaactggttcgactactggggccaaggaaccctggtcaccgtctcctcagctagc

SEQ ID NO: 2583 - DNA, 380 bp, Artificial Sequence
  gi|Fabrus|E06_VH3-23_IGHD6-25*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcggctactcctacaactggttcgactactggggccaaggaaccctggtcaccgtctcctcagctagc

SEQ ID NO: 2584 - DNA, 380 bp, Artificial Sequence
  gi|Fabrus|E07_VH3-23_IGHD6-25*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcggctacgtcctacaactggttcgactactggggccaaggaaccctggtcaccgtctcctcagctagc

SEQ ID NO: 2585 - DNA, 374 bp, Artificial Sequence
  gi|Fabrus|E08_VH3-23_IGHD7-27*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaactaactggggagtcctacaactggttcgactactggggccaaggaaccctggtcaccgtctcctcagctagc

SEQ ID NO: 2586 - DNA, 374 bp, Artificial Sequence
  gi|Fabrus|E09_VH3-23_IGHD7-27*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagctaactggggatcctacaactggttcgactactggggccaaggaaccctggtcaccgtctcctcagctagc

SEQ ID NO: 2587 - DNA, 380 bp, Artificial Sequence
  gi|Fabrus|A01_VH3-23_IGHD1-1*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttgtaccgtcctacaactggttcgactactggggccaaggaaccctggtcaccgtctcctcagctagc

SEQ ID NO: 2588 - DNA, 380 bp, Artificial Sequence
  gi|Fabrus|A02_VH3-23_IGHD1-1*01>2'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttgtaccggtcctacaactggttcgactactggggccaaggaaccctggtcaccgtctcctcagctagc

SEQ ID NO: 2589 - DNA, 380 bp, Artificial Sequence
  gi|Fabrus|A03_VH3-23_IGHD1-1*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttgtacctcctacaactggttcgactactggggccaaggaaccctggtcaccgtctcctcagctagc

SEQ ID NO: 2590 - DNA, 380 bp, Artificial Sequence
  gi|Fabrus|A04_VH3-23_IGHD1-7*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttccagttataccgtcctacaactggttcgactactggggccaaggaaccctggtcaccgtctcctcagctagc

SEQ ID NO: 2591 - DNA, 380 bp, Artificial Sequence
  gi|Fabrus|A05_VH3-23_IGHD1-7*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttccagttatacctcctacaactggttcgactactggggccaaggaaccctggtcaccgtctcctcagctagc

SEQ ID NO: 2592 - DNA, 380 bp, Artificial Sequence
  gi|Fabrus|A06_VH3-23_IGHD1-14*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggttccggttataccgtcctacaactggttcgactactggggccaaggaaccctggtcaccgtctcctcagctagc

SEQ ID NO: 2593 - DNA, 380 bp, Artificial Sequence
  gi|Fabrus|A07_VH3-23_IGHD1-14*01>2'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggttccggttataccggtcctacaactggttcgactactggggccaaggaaccctggtcaccgtctcctcagctagc

SEQ ID NO: 2594 - DNA, 380 bp, Artificial Sequence
  gi|Fabrus|A08_VH3-23_IGHD1-14*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggttccggttatacctcctacaactggttcgactactggggccaaggaaccctggtcaccgtctcctcagctagc

SEQ ID NO: 2595 - DNA, 380 bp, Artificial Sequence
  gi|Fabrus|A09_VH3-23_IGHD1-20*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttataccgtcctacaactggttcgactactggggccaaggaaccctggtcaccgtctcctcagctagc

SEQ ID NO: 2596 - DNA, 380 bp, Artificial Sequence
  gi|Fabrus|A10_VH3-23_IGHD1-20*01>2'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttataccggtcctacaactggttcgactactggggccaaggaaccctggtcaccgtctcctcagctagc

SEQ ID NO: 2597 - DNA, 380 bp, Artificial Sequence
  gi|Fabrus|A11_VH3-23_IGHD1-20*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttatacctcctacaactggttcgactactggggccaaggaaccctggtcaccgtctcctcagctagc

SEQ ID NO: 2598 - DNA, 383 bp, Artificial Sequence
  gi|Fabrus|A12_VH3-23_IGHD1-26*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtagctcccactataccgtcctacaactggttcgactactggggccaaggaaccctggtcaccgtctcctcagctagc

SEQ ID NO: 2599 - DNA, 383 bp, Artificial Sequence
  gi|Fabrus|B01_VH3-23_IGHD1-26*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtagctcccactatacctcctacaactggttcgactactggggccaaggaaccctggtcaccgtctcctcagctagc

SEQ ID NO: 2600 - DNA, 392 bp, Artificial Sequence
  gi|Fabrus|B02_VH3-23_IGHD2-2*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcatagcagctggtactactacaatatcctcctacaactggttcgactactggggccaaggaaccctggtcaccgtctcctcagctagc

SEQ ID NO: 2601 - DNA, 392 bp, Artificial Sequence
  gi|Fabrus|B03_VH3-23_IGHD2-2*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggcatagcagctggtactactacaatatctcctacaactggttcgactactggggccaaggaaccctggtcaccgtctcctcagctagc

SEQ ID NO: 2602 - DNA, 392 bp, Artificial Sequence
  gi|Fabrus|B04_VH3-23_IGHD2-8*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcatacaccattagtacaatatcctcctacaactggttcgactactggggccaaggaaccctggtcaccgtctcctcagctagc

SEQ ID NO: 2603 - DNA, 392 bp, Artificial Sequence
  gi|Fabrus|B05_VH3-23_IGHD2-15*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagtagcagctaccaccactacaatatcctcctacaactggttcgactactggggccaaggaaccctggtcaccgtctcctcagctagc

SEQ ID NO: 2604 - DNA, 392 bp, Artificial Sequence
  gi|Fabrus|B06_VH3-23_IGHD2-15*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagtagcagctaccaccactacaatatctcctacaactggttcgactactggggccaaggaaccctggtcaccgtctcctcagctagc

SEQ ID NO: 2605 - DNA, 389 bp, Artificial Sequence
  gi|Fabrus|B07_VH3-23_IGHD2-21*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggaatagcaatcaccaccacaatatgctcctacaactggttcgactactggggccaaggaaccctggtcaccgtctcctcagctagc

SEQ ID NO: 2606 - DNA, 389 bp, Artificial Sequence
  gi|Fabrus|B08_VH3-23_IGHD2-21*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggaatagcaatcaccaccacaatatgtcctacaactggttcgactactggggccaaggaaccctggtcaccgtctcctcagctagc

SEQ ID NO: 2607 - DNA, 392 bp, Artificial Sequence
  gi|Fabrus|B09_VH3-23_IGHD3-3*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataataaccactccaaaaatcgtaatatcctacaactggttcgactactggggccaaggaaccctggtcaccgtctcctcagctagc

SEQ ID NO: 2608 - DNA, 392 bp, Artificial Sequence
  gi|Fabrus|B10_VH3-23_IGHD3-3*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataataaccactccaaaaatcgtaattcctacaactggttcgactactggggccaaggaaccctggtcaccgtctcctcagctagc

SEQ ID NO: 2609 - DNA, 392 bp, Artificial Sequence
  gi|Fabrus|B11_VH3-23_IGHD3-9*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataaccagtcaaaatatcgtaatatcctacaactggttcgactactggggccaaggaaccctggtcaccgtctcctcagctagc

SEQ ID NO: 2610 - DNA, 392 bp, Artificial Sequence
  gi|Fabrus|B12_VH3-23_IGHD3-9*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataaccagtcaaaatatcgtaattcctacaactggttcgactactggggccaaggaaccctggtcaccgtctcctcagctagc

SEQ ID NO: 2611 - DNA, 392 bp, Artificial Sequence
  gi|Fabrus|C01_VH3-23_IGHD3-10*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataactccccgaaccatagtaatatcctacaactggttcgactactggggccaaggaaccctggtcaccgtctcctcagctagc

SEQ ID NO: 2612 - DNA, 392 bp, Artificial Sequence
  gi|Fabrus|C02_VH3-23_IGHD3-10*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataactccccgaaccatagtaattcctacaactggttcgactactggggccaaggaaccctggtcaccgtctcctcagctagc

SEQ ID NO: 2613 - DNA, 398 bp, Artificial Sequence
  gi|Fabrus|C03_VH3-23_IGHD3-16*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataagcataactcccccaaacgtaatcataatatcctacaactggttcgactactggggccaaggaaccctggtcaccgtctcctcagctagc

SEQ ID NO: 2614 - DNA, 398 bp, Artificial Sequence
  gi|Fabrus|C04_VH3-23_IGHD3-16*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataagcataactcccccaaacgtaatcataattcctacaactggttcgactactggggccaaggaaccctggtcaccgtctcctcagctagc

SEQ ID NO: 2615 - DNA, 392 bp, Artificial Sequence
  gi|Fabrus|C05_VH3-23_IGHD3-22*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtaataaccactactatcatagtaatatcctacaactggttcgactactggggccaaggaaccctggtcaccgtctcctcagctagc

SEQ ID NO: 2616 - DNA, 377 bp, Artificial Sequence
  gi|Fabrus|C06_VH3-23_IGHD4-4*01(1)>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttactgtagtctcctacaactggttcgactactggggccaaggaaccctggtcaccgtctcctcagctagc

SEQ ID NO: 2617 - DNA, 377 bp, Artificial Sequence
  gi|Fabrus|C07_VH3-23_IGHD4-4*01(1)>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttactgtagttcctacaactggttcgactactggggccaaggaaccctggtcaccgtctcctcagctagc

SEQ ID NO: 2618 - DNA, 377 bp, Artificial Sequence; identical to SEQ ID NO: 2616
  gi|Fabrus|C08_VH3-23_IGHD4-11*01(1)>1'_IGHJ5*01

SEQ ID NO: 2619 - DNA, 377 bp, Artificial Sequence; identical to SEQ ID NO: 2617
  gi|Fabrus|C09_VH3-23_IGHD4-11*01(1)>3'_IGHJ5*01

SEQ ID NO: 2620 - DNA, 377 bp, Artificial Sequence
  gi|Fabrus|C10_VH3-23_IGHD4-17*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtcaccgtagtctcctacaactggttcgactactggggccaaggaaccctggtcaccgtctcctcagctagc

SEQ ID NO: 2621 - DNA, 377 bp, Artificial Sequence
  gi|Fabrus|C11_VH3-23_IGHD4-17*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtcaccgtagttcctacaactggttcgactactggggccaaggaaccctggtcaccgtctcctcagctagc

SEQ ID NO: 2622 - DNA, 380 bp, Artificial Sequence
  gi|Fabrus|C12_VH3-23_IGHD4-23*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagttaccaccgtagtctcctacaactggttcgactactggggccaaggaaccctggtcaccgtctcctcagctagc

SEQ ID NO: 2623 - DNA, 380 bp, Artificial Sequence
  gi|Fabrus|D01_VH3-23_IGHD4-23*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagttaccaccgtagttcctacaactggttcgactactggggccaaggaaccctggtcaccgtctcctcagctagc

SEQ ID NO: 2624 - DNA, 383 bp, Artificial Sequence
  gi|Fabrus|D02_VH3-23_IGHD5-5*01(2)>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaaccatagctgtatccacgtcctacaactggttcgactactggggccaaggaaccctggtcaccgtctcctcagctagc

SEQ ID NO: 2625 - DNA, 383 bp, Artificial Sequence
  gi|Fabrus|D03_VH3-23_IGHD5-5*01(2)>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaaccatagctgtatccactcctacaactggttcgactactggggccaaggaaccctggtcaccgtctcctcagctagc

SEQ ID NO: 2626 - DNA, 386 bp, Artificial Sequence
  gi|Fabrus|D04_VH3-23_IGHD5-12*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaatcgtagccactatatccacgtcctacaactggttcgactactggggccaaggaaccctggtcaccgtctcctcagctagc

SEQ ID NO: 2627 - DNA, 386 bp, Artificial Sequence
  gi|Fabrus|D05_VH3-23_IGHD5-12*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaatcgtagccactatatccactcctacaactggttcgactactggggccaaggaaccctggtcaccgtctcctcagctagc

SEQ ID NO: 2628 - DNA, 383 bp, Artificial Sequence; identical to SEQ ID NO: 2624
  gi|Fabrus|D06_VH3-23_IGHD5-18*01(2)>1'_IGHJ5*01

SEQ ID NO: 2629 - DNA, 383 bp, Artificial Sequence; identical to SEQ ID NO: 2625
  gi|Fabrus|D07_VH3-23_IGHD5-18*01(2)>3'_IGHJ5*01

SEQ ID NO: 2630 - DNA, 383 bp, Artificial Sequence
  gi|Fabrus|D08_VH3-23_IGHD5-24*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaattgtagccatctctacgtcctacaactggttcgactactggggccaaggaaccctggtcaccgtctcctcagctagc

SEQ ID NO: 2631 - DNA, 383 bp, Artificial Sequence
  gi|Fabrus|D09_VH3-23_IGHD5-24*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaattgtagccatctctactcctacaactggttcgactactggggccaaggaaccctggtcaccgtctcctcagctagc

SEQ ID NO: 2632 - DNA, 380 bp, Artificial Sequence
  gi|Fabrus|D10_VH3-23_IGHD6-6*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggacgagctgctatactctcctacaactggttcgactactggggccaaggaaccctggtcaccgtctcctcagctagc

SEQ ID NO: 2633 - DNA, 380 bp, Artificial Sequence
  gi|Fabrus|D11_VH3-23_IGHD6-6*01>2'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagacgagctgctatactcgtcctacaactggttcgactactggggccaaggaaccctggtcaccgtctcctcagctagc

SEQ ID NO: 2634 - DNA, 380 bp, Artificial Sequence
  gi|Fabrus|D12_VH3-23_IGHD6-6*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggacgagctgctatacttcctacaactggttcgactactggggccaaggaaccctggtcaccgtctcctcagctagc

SEQ ID NO: 2635 - DNA, 383 bp, Artificial Sequence
  gi|Fabrus|E01_VH3-23_IGHD6-13*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagctgctgctataccctcctacaactggttcgactactggggccaaggaaccctggtcaccgtctcctcagctagc

SEQ ID NO: 2636 - DNA, 383 bp, Artificial Sequence
  gi|Fabrus|E02_VH3-23_IGHD6-13*01>2'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagctgctgctatacccgtcctacaactggttcgactactggggccaaggaaccctggtcaccgtctcctcagctagc

SEQ ID NO: 2637 - DNA, 383 bp, Artificial Sequence
  gi|Fabrus|E03_VH3-23_IGHD6-13*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagctgctgctatacctcctacaactggttcgactactggggccaaggaaccctggtcaccgtctcctcagctagc

SEQ ID NO: 2638 - DNA, 383 bp, Artificial Sequence
  gi|Fabrus|E04_VH3-23_IGHD6-19*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagccactgctataccctcctacaactggttcgactactggggccaaggaaccctggtcaccgtctcctcagctagc

SEQ ID NO: 2639 - DNA, 383 bp, Artificial Sequence
  gi|Fabrus|E05_VH3-23_IGHD6-19*01>2'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagccactgctatacccgtcctacaactggttcgactactggggccaaggaaccctggtcaccgtctcctcagctagc

SEQ ID NO: 2640 - DNA, 383 bp, Artificial Sequence
  gi|Fabrus|E06_VH3-23_IGHD6-19*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagccactgctatacctcctacaactggttcgactactggggccaaggaaccctggtcaccgtctcctcagctagc

SEQ ID NO: 2641 - DNA, 380 bp, Artificial Sequence
  gi|Fabrus|E07_VH3-23_IGHD6-25*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagccgctgctataccctcctacaactggttcgactactggggccaaggaaccctggtcaccgtctcctcagctagc

SEQ ID NO: 2642 - DNA, 380 bp, Artificial Sequence
  gi|Fabrus|E08_VH3-23_IGHD6-25*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagccgctgctatacctcctacaactggttcgactactggggccaaggaaccctggtcaccgtctcctcagctagc

SEQ ID NO: 2643 - DNA, 374 bp, Artificial Sequence
  gi|Fabrus|E09_VH3-23_IGHD7-27*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatccccagttaggtcctacaactggttcgactactggggccaaggaaccctggtcaccgtctcctcagctagc

SEQ ID NO: 2644 - DNA, 374 bp, Artificial Sequence
  gi|Fabrus|E10_VH3-23_IGHD7-27*01>2'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccccagttagggtcctacaactggttcgactactggggccaaggaaccctggtcaccgtctcctcagctagc

SEQ ID NO: 2645 - DNA, 392 bp, Artificial Sequence
  gi|Fabrus|A01_VH3-23_IGHD1-1*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtacaactggaacgacgtcctattactactactactacggtatggacgtctggggccaaggaaccctggtcaccgtctcctcagctagc

SEQ ID NO: 2646 - DNA, 392 bp, Artificial Sequence
  gi|Fabrus|A02_VH3-23_IGHD1-1*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtacaactggaacgacggtcctattactactactactacggtatggacgtctggggccaaggaaccctggtcaccgtctcctcagctagc

SEQ ID NO: 2647 - DNA, 392 bp, Artificial Sequence
  gi|Fabrus|A03_VH3-23_IGHD1-1*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtacaactggaacgactcctattactactactactacggtatggacgtctggggccaaggaaccctggtcaccgtctcctcagctagc

SEQ ID NO: 2648 - DNA, 392 bp, Artificial Sequence
  gi|Fabrus|A04_VH3-23_IGHD1-7*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaactacgtcctattactactactactacggtatggacgtctggggccaaggaaccctggtcaccgtctcctcagctagc

SEQ ID NO: 2649 - DNA, 392 bp, Artificial Sequence
  gi|Fabrus|A05_VH3-23_IGHD1-7*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaactactcctattactactactactacggtatggacgtctggggccaaggaaccctggtcaccgtctcctcagctagc

SEQ ID NO: 2650 - DNA, 392 bp, Artificial Sequence
  gi|Fabrus|A06_VH3-23_IGHD1-14*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataaccggaaccacgtcctattactactactactacggtatggacgtctggggccaaggaaccctggtcaccgtctcctcagctagc

SEQ ID NO: 2651 - DNA, 392 bp, Artificial Sequence
  gi|Fabrus|A07_VH3-23_IGHD1-14*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataaccggaaccactcctattactactactactacggtatggacgtctggggccaaggaaccctggtcaccgtctcctcagctagc

SEQ ID NO: 2652 - DNA, 392 bp, Artificial Sequence
  gi|Fabrus|A08_VH3-23_IGHD1-20*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaacgacgtcctattactactactactacggtatggacgtctggggccaaggaaccctggtcaccgtctcctcagctagc

SEQ ID NO: 2653 - DNA, 392 bp, Artificial Sequence
  gi|Fabrus|A09_VH3-23_IGHD1-20*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaacgactcctattactactactactacggtatggacgtctggggccaaggaaccctggtcaccgtctcctcagctagc

SEQ ID NO: 2654 - DNA, 395 bp, Artificial Sequence
  gi|Fabrus|A10_VH3-23_IGHD1-26*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagtgggagctactacgtcctattactactactactacggtatggacgtctggggccaaggaaccctggtcaccgtctcctcagctagc

SEQ ID NO: 2655 - DNA, 395 bp, Artificial Sequence
  gi|Fabrus|A11_VH3-23_IGHD1-26*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagtgggagctactactcctattactactactactacggtatggacgtctggggccaaggaaccctggtcaccgtctcctcagctagc

SEQ ID NO: 2656 - DNA, 404 bp, Artificial Sequence
  gi|Fabrus|A12_VH3-23_IGHD2-2*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtagtaccagctgctatgcctcctattactactactactacggtatggacgtctggggccaaggaaccctggtcaccgtctcctcagctagc

SEQ ID NO: 2657 - DNA, 404 bp, Artificial Sequence
  gi|Fabrus|B01_VH3-23_IGHD2-2*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtagtaccagctgctatgtcctattactactactactacggtatggacgtctggggccaaggaaccctggtcaccgtctcctcagctagc

SEQ ID NO: 2658 - DNA, 404 bp, Artificial Sequence
  gi|Fabrus|B02_VH3-23_IGHD2-8*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtactaatggtgtatgctatacctcctattactactactactacggtatggacgtctggggccaaggaaccctggtcaccgtctcctcagctagc

SEQ ID NO: 2659 - DNA, 404 bp, Artificial Sequence
  gi|Fabrus|B03_VH3-23_IGHD2-8*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtactaatggtgtatgctatatcctattactactactactacggtatggacgtctggggccaaggaaccctggtcaccgtctcctcagctagc

SEQ ID NO: 2660 - DNA, 404 bp, Artificial Sequence
  gi|Fabrus|B04_VH3-23_IGHD2-15*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtggtggtagctgctactcctcctattactactactactacggtatggacgtctggggccaaggaaccctggtcaccgtctcctcagctagc

SEQ ID NO: 2661 - DNA, 404 bp, Artificial Sequence
  gi|Fabrus|B05_VH3-23_IGHD2-15*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtggtggtagctgctacttcctattactactactactacggtatggacgtctggggccaaggaaccctggtcaccgtctcctcagctagc

SEQ ID NO: 2662 - DNA, 401 bp, Artificial Sequence
  gi|Fabrus|B06_VH3-23_IGHD2-21*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagcatattgtggtggtgattgctattcctcctattactactactactacggtatggacgtctggggccaaggaaccctggtcaccgtctcctcagctagc

SEQ ID NO: 2663 - DNA, 401 bp, Artificial Sequence
  gi|Fabrus|B07_VH3-23_IGHD2-21*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagcatattgtggtggtgattgctatttcctattactactactactacggtatggacgtctggggccaaggaaccctggtcaccgtctcctcagctagc

SEQ ID NO: 2664 - DNA, 404 bp, Artificial Sequence
  gi|Fabrus|B08_VH3-23_IGHD3-3*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtattacgatttttggagtggttattatactcctattactactactactacggtatggacgtctggggccaaggaaccctggtcaccgtctcctcagctagc

SEQ ID NO: 2665 - DNA, 404 bp, Artificial Sequence
  gi|Fabrus|B09_VH3-23_IGHD3-3*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatttttggagtggttattatacctcctattactactactactacggtatggacgtctggggccaaggaaccctggtcaccgtctcctcagctagc

SEQ ID NO: 2666 - DNA, 404 bp, Artificial Sequence
  gi|Fabrus|B10_VH3-23_IGHD3-3*01>3_IGHJ6*0
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattacgatttttggagtggttattatatcctattactactactactacggtatggacgtctggggccaaggaaccctggtcaccgtctcctcagctagc

SEQ ID NO: 2667 - DNA, 404 bp, Artificial Sequence
  gi|Fabrus|B11_VH3-23_IGHD3-9*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatattttgactggttattataactcctattactactactactacggtatggacgtctggggccaaggaaccctggtcaccgtctcctcagctagc

SEQ ID NO: 2668 - DNA, 404 bp, Artificial Sequence
  gi|Fabrus|B12_VH3-23_IGHD3-10*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatggttcggggagttattataactcctattactactactactacggtatggacgtctggggccaaggaaccctggtcaccgtctcctcagctagc

SEQ ID NO: 2669 - DNA, 404 bp, Artificial Sequence
  gi|Fabrus|C01_VH3-23_IGHD3-10*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatggttcggggagttattatatcctattactactactactacggtatggacgtctggggccaaggaaccctggtcaccgtctcctcagctagc

SEQ ID NO: 2670 - DNA, 410 bp, Artificial Sequence
  gi|Fabrus|C02_VH3-23_IGHD3-16*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattatgattacgtttgggggagttatgcttatacctcctattactactactactacggtatggacgtctggggccaaggaaccctggtcaccgtctcctcagctagc

SEQ ID NO: 2671 - DNA, 410 bp, Artificial Sequence
  gi|Fabrus|C03_VH3-23_IGHD3-16*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattatgattacgtttgggggagttatgcttatatcctattactactactactacggtatggacgtctggggccaaggaaccctggtcaccgtctcctcagctagc

SEQ ID NO: 2672 - DNA, 404 bp, Artificial Sequence
  gi|Fabrus|C04_VH3-23_IGHD3-22*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatgatagtagtggttattactactcctattactactactactacggtatggacgtctggggccaaggaaccctggtcaccgtctcctcagctagc

SEQ ID NO: 2673 - DNA, 404 bp, Artificial Sequence
  gi|Fabrus|C05_VH3-23_IGHD3-22*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatgatagtagtggttattacttcctattactactactactacggtatggacgtctggggccaaggaaccctggtcaccgtctcctcagctagc

SEQ ID NO: 2674 - DNA, 389 bp, Artificial Sequence
  gi|Fabrus|C06_VH3-23_IGHD4-4*01(1)>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacagtaactactcctattactactactactacggtatggacgtctggggccaaggaaccctggtcaccgtctcctcagctagc

SEQ ID NO: 2675 - DNA, 389 bp, Artificial Sequence
  gi|Fabrus|C07_VH3-23_IGHD4-4*01(1)>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacagtaacttcctattactactactactacggtatggacgtctggggccaaggaaccctggtcaccgtctcctcagctagc

SEQ ID NO: 2676 - DNA, 389 bp, Artificial Sequence; identical to SEQ ID NO: 2674
  gi|Fabrus|C08_VH3-23_IGHD4-11*01(1)>2_IGHJ6*01

SEQ ID NO: 2677 - DNA, 389 bp, Artificial Sequence; identical to SEQ ID NO: 2675
  gi|Fabrus|C09_VH3-23_IGHD4-11*01(1)>3_IGHJ6*01

SEQ ID NO: 2678 - DNA, 389 bp, Artificial Sequence
  gi|Fabrus|C10_VH3-23_IGHD4-17*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtgactactcctattactactactactacggtatggacgtctggggccaaggaaccctggtcaccgtctcctcagctagc

SEQ ID NO: 2679 - DNA, 389 bp, Artificial Sequence
  gi|Fabrus|C11_VH3-23_IGHD4-17*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtgacttcctattactactactactacggtatggacgtctggggccaaggaaccctggtcaccgtctcctcagctagc

SEQ ID NO: 2680 - DNA, 392 bp, Artificial Sequence
  gi|Fabrus|C12_VH3-23_IGHD4-23*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtggtaactcctcctattactactactactacggtatggacgtctggggccaaggaaccctggtcaccgtctcctcagctagc

SEQ ID NO: 2681 - DNA, 392 bp, Artificial Sequence
  gi|Fabrus|D01_VH3-23_IGHD4-23*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtggtaacttcctattactactactactacggtatggacgtctggggccaaggaaccctggtcaccgtctcctcagctagc

SEQ ID NO: 2682 - DNA, 395 bp, Artificial Sequence
  gi|Fabrus|D02_VH3-23_IGHD5-5*01(2)>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatacagctatggttacgtcctattactactactactacggtatggacgtctggggccaaggaaccctggtcaccgtctcctcagctagc

SEQ ID NO: 2683 - DNA, 395 bp, Artificial Sequence
  gi|Fabrus|D03_VH3-23_IGHD5-5*01(2)>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggatacagctatggttacggtcctattactactactactacggtatggacgtctggggccaaggaaccctggtcaccgtctcctcagctagc

SEQ ID NO: 2684 - DNA, 395 bp, Artificial Sequence
  gi|Fabrus|D04_VH3-23_IGHD5-5*01(2)>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatacagctatggttactcctattactactactactacggtatggacgtctggggccaaggaaccctggtcaccgtctcctcagctagc

SEQ ID NO: 2685 - DNA, 398 bp, Artificial Sequence
  gi|Fabrus|D05_VH3-23_IGHD5-12*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatatagtggctacgattacgtcctattactactactactacggtatggacgtctggggccaaggaaccctggtcaccgtctcctcagctagc

SEQ ID NO: 2686 - DNA, 398 bp, Artificial Sequence
  gi|Fabrus|D06_VH3-23_IGHD5-12*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatatagtggctacgattactcctattactactactactacggtatggacgtctggggccaaggaaccctggtcaccgtctcctcagctagc

SEQ ID NO: 2687 - DNA, 395 bp, Artificial Sequence; identical to SEQ ID NO: 2682
  gi|Fabrus|D07_VH3-23_IGHD5-18*01(2)>1_IGHJ6*01

SEQ ID NO: 2688 - DNA, 395 bp, Artificial Sequence; identical to SEQ ID NO: 2683
  gi|Fabrus|D08_VH3-23_IGHD5-18*01(2)>2_IGHJ6*01

SEQ ID NO: 2689 - DNA, 395 bp, Artificial Sequence; identical to SEQ ID NO: 2684
  gi|Fabrus|D09_VH3-23_IGHD5-18*01(2)>3_IGHJ6*01

SEQ ID NO: 2690 - DNA, 395 bp, Artificial Sequence
  gi|Fabrus|D10_VH3-23_IGHD5-24*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagagatggctacaattacgtcctattactactactactacggtatggacgtctggggccaaggaaccctggtcaccgtctcctcagctagc

SEQ ID NO: 2691 - DNA, 395 bp, Artificial Sequence
  gi|Fabrus|D11_VH3-23_IGHD5-24*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagagatggctacaattactcctattactactactactacggtatggacgtctggggccaaggaaccctggtcaccgtctcctcagctagc

SEQ ID NO: 2692 - DNA, 392 bp, Artificial Sequence
  gi|Fabrus|D12_VH3-23_IGHD6-6*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagtatagcagctcgtcctcctattactactactactacggtatggacgtctggggccaaggaaccctggtcaccgtctcctcagctagc

SEQ ID NO: 2693 - DNA, 392 bp, Artificial Sequence
  gi|Fabrus|E01_VH3-23_IGHD6-6*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaagtatagcagctcgtccgtcctattactactactactacggtatggacgtctggggccaaggaaccctggtcaccgtctcctcagctagc

SEQ ID NO: 2694 - DNA, 395 bp, Artificial Sequence
  gi|Fabrus|E02_VH3-23_IGHD6-13*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcagctggtactcctattactactactactacggtatggacgtctggggccaaggaaccctggtcaccgtctcctcagctagc

SEQ ID NO: 2695 - DNA, 395 bp, Artificial Sequence
  gi|Fabrus|E03_VH3-23_IGHD6-13*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcagctggtacgtcctattactactactactacggtatggacgtctggggccaaggaaccctggtcaccgtctcctcagctagc

SEQ ID NO: 2696 - DNA, 395 bp, Artificial Sequence
  gi|Fabrus|E04_VH3-23_IGHD6-19*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagtggctggtactcctattactactactactacggtatggacgtctggggccaaggaaccctggtcaccgtctcctcagctagc

SEQ ID NO: 2697 - DNA, 395 bp, Artificial Sequence
  gi|Fabrus|E05_VH3-23_IGHD6-19*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagtggctggtacgtcctattactactactactacggtatggacgtctggggccaaggaaccctggtcaccgtctcctcagctagc

SEQ ID NO: 2698 - DNA, 392 bp, Artificial Sequence
  gi|Fabrus|E06_VH3-23_IGHD6-25*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcggctactcctattactactactactacggtatggacgtctggggccaaggaaccctggtcaccgtctcctcagctagc

SEQ ID NO: 2699 - DNA, 392 bp, Artificial Sequence
  gi|Fabrus|E07_VH3-23_IGHD6-25*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcggctacgtcctattactactactactacggtatggacgtctggggccaaggaaccctggtcaccgtctcctcagctagc

SEQ ID NO: 2700 - DNA, 386 bp, Artificial Sequence
  gi|Fabrus|E08_VH3-23_IGHD7-27*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaactaactggggagtcctattactactactactacggtatggacgtctggggccaaggaaccctggtcaccgtctcctcagctagc

SEQ ID NO: 2701 - DNA, 386 bp, Artificial Sequence
  gi|Fabrus|E09_VH3-23_IGHD7-27*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagctaactggggatcctattactactactactacggtatggacgtctggggccaaggaaccctggtcaccgtctcctcagctagc

SEQ ID NO: 2702 - DNA, 392 bp, Artificial Sequence
  gi|Fabrus|A01_VH3-23_IGHD1-1*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttgtaccgtcctattactactactactacggtatggacgtctggggccaaggaaccctggtcaccgtctcctcagctagc

SEQ ID NO: 2703 - DNA, 392 bp, Artificial Sequence
  gi|Fabrus|A02_VH3-23_IGHD1-1*01>2'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttgtaccggtcctattactactactactacggtatggacgtctggggccaaggaaccctggtcaccgtctcctcagctagc

SEQ ID NO: 2704 - DNA, 392 bp, Artificial Sequence
  gi|Fabrus|A03_VH3-23_IGHD1-1*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttgtacctcctattactactactactacggtatggacgtctggggccaaggaaccctggtcaccgtctcctcagctagc

SEQ ID NO: 2705 - DNA, 392 bp, Artificial Sequence
  gi|Fabrus|A04_VH3-23_IGHD1-7*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttccagttataccgtcctattactactactactacggtatggacgtctggggccaaggaaccctggtcaccgtctcctcagctagc

SEQ ID NO: 2706 - DNA, 392 bp, Artificial Sequence
  gi|Fabrus|A05_VH3-23_IGHD1-7*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttccagttatacctcctattactactactactacggtatggacgtctggggccaaggaaccctggtcaccgtctcctcagctagc

SEQ ID NO: 2707 - DNA, 392 bp, Artificial Sequence
  gi|Fabrus|A06_VH3-23_IGHD1-14*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggttccggttataccgtcctattactactactactacggtatggacgtctggggccaaggaaccctggtcaccgtctcctcagctagc

SEQ ID NO: 2708 - DNA, 392 bp, Artificial Sequence
  gi|Fabrus|A07_VH3-23_IGHD1-14*01>2'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggttccggttataccggtcctattactactactactacggtatggacgtctggggccaaggaaccctggtcaccgtctcctcagctagc

SEQ ID NO: 2709 - DNA, 392 bp, Artificial Sequence
  gi|Fabrus|A08_VH3-23_IGHD1-14*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggttccggttatacctcctattactactactactacggtatggacgtctggggccaaggaaccctggtcaccgtctcctcagctagc

SEQ ID NO: 2710 - DNA, 392 bp, Artificial Sequence
  gi|Fabrus|A09_VH3-23_IGHD1-20*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttataccgtcctattactactactactacggtatggacgtctggggccaaggaaccctggtcaccgtctcctcagctagc

SEQ ID NO: 2711 - DNA, 392 bp, Artificial Sequence
  gi|Fabrus|A10_VH3-23_IGHD1-20*01>2'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttataccggtcctattactactactactacggtatggacgtctggggccaaggaaccctggtcaccgtctcctcagctagc

SEQ ID NO: 2712 - DNA, 392 bp, Artificial Sequence
  gi|Fabrus|A11_VH3-23_IGHD1-20*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttatacctcctattactactactactacggtatggacgtctggggccaaggaaccctggtcaccgtctcctcagctagc

SEQ ID NO: 2713 - DNA, 395 bp, Artificial Sequence
  gi|Fabrus|A12_VH3-23_IGHD1-26*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtagctcccactataccgtcctattactactactactacggtatggacgtctggggccaaggaaccctggtcaccgtctcctcagctagc

SEQ ID NO: 2714 - DNA, 395 bp, Artificial Sequence
  gi|Fabrus|B01_VH3-23_IGHD1-26*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtagctcccactatacctcctattactactactactacggtatggacgtctggggccaaggaaccctggtcaccgtctcctcagctagc

SEQ ID NO: 2715 - DNA, 404 bp, Artificial Sequence
  gi|Fabrus|B02_VH3-23_IGHD2-2*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcatagcagctggtactactacaatatcctcctattactactactactacggtatggacgtctggggccaaggaaccctggtcaccgtctcctcagctagc

SEQ ID NO: 2716 - DNA, 404 bp, Artificial Sequence
  gi|Fabrus|B03_VH3-23_IGHD2-2*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggcatagcagctggtactactacaatatctcctattactactactactacggtatggacgtctggggccaaggaaccctggtcaccgtctcctcagctagc

SEQ ID NO: 2717 - DNA, 404 bp, Artificial Sequence
  gi|Fabrus|B04_VH3-23_IGHD2-8*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcatacaccattagtacaatatcctcctattactactactactacggtatggacgtctggggccaaggaaccctggtcaccgtctcctcagctagc

SEQ ID NO: 2718 - DNA, 404 bp, Artificial Sequence
  gi|Fabrus|B05_VH3-23_IGHD2-15*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagtagcagctaccaccactacaatatcctcctattactactactactacggtatggacgtctggggccaaggaaccctggtcaccgtctcctcagctagc

SEQ ID NO: 2719 - DNA, 404 bp, Artificial Sequence
  gi|Fabrus|B06_VH3-23_IGHD2-15*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagtagcagctaccaccactacaatatctcctattactactactactacggtatggacgtctggggccaaggaaccctggtcaccgtctcctcagctagc

SEQ ID NO: 2720 - DNA, 401 bp, Artificial Sequence
  gi|Fabrus|B07_VH3-23_IGHD2-21*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggaatagcaatcaccaccacaatatgctcctattactactactactacggtatggacgtctggggccaaggaaccctggtcaccgtctcctcagctagc

SEQ ID NO: 2721 - DNA, 401 bp, Artificial Sequence
  gi|Fabrus|B08_VH3-23_IGHD2-21*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggaatagcaatcaccaccacaatatgtcctattactactactactacggtatggacgtctggggccaaggaaccctggtcaccgtctcctcagctagc

SEQ ID NO: 2722 - DNA, 404 bp, Artificial Sequence
  gi|Fabrus|B09_VH3-23_IGHD3-3*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataataaccactccaaaaatcgtaatatcctattactactactactacggtatggacgtctggggccaaggaaccctggtcaccgtctcctcagctagc

SEQ ID NO: 2723 - DNA, 404 bp, Artificial Sequence
  gi|Fabrus|B10_VH3-23_IGHD3-3*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataataaccactccaaaaatcgtaattcctattactactactactacggtatggacgtctggggccaaggaaccctggtcaccgtctcctcagctagc

SEQ ID NO: 2724 - DNA, 404 bp, Artificial Sequence
  gi|Fabrus|B11_VH3-23_IGHD3-9*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataaccagtcaaaatatcgtaatatcctattactactactactacggtatggacgtctggggccaaggaaccctggtcaccgtctcctcagctagc

SEQ ID NO: 2725 - DNA, 404 bp, Artificial Sequence
  gi|Fabrus|B12_VH3-23_IGHD3-9*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataaccagtcaaaatatcgtaattcctattactactactactacggtatggacgtctggggccaaggaaccctggtcaccgtctcctcagctagc

SEQ ID NO: 2726 - DNA, 404 bp, Artificial Sequence
  gi|Fabrus|C01_VH3-23_IGHD3-10*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataactccccgaaccatagtaatatcctattactactactactacggtatggacgtctggggccaaggaaccctggtcaccgtctcctcagctagc

SEQ ID NO: 2727 - DNA, 404 bp, Artificial Sequence
  gi|Fabrus|C02_VH3-23_IGHD3-10*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataactccccgaaccatagtaattcctattactactactactacggtatggacgtctggggccaaggaaccctggtcaccgtctcctcagctagc

SEQ ID NO: 2728 - DNA, 410 bp, Artificial Sequence
  gi|Fabrus|C03_VH3-23_IGHD3-16*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataagcataactcccccaaacgtaatcataatatcctattactactactactacggtatggacgtctggggccaaggaaccctggtcaccgtctcctcagctagc

SEQ ID NO: 2729 - DNA, 410 bp, Artificial Sequence
  gi|Fabrus|C04_VH3-23_IGHD3-16*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataagcataactcccccaaacgtaatcataattcctattactactactactacggtatggacgtctggggccaaggaaccctggtcaccgtctcctcagctagc

SEQ ID NO: 2730 - DNA, 404 bp, Artificial Sequence
  gi|Fabrus|C05_VH3-23_IGHD3-22*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtaataaccactactatcatagtaatatcctattactactactactacggtatggacgtctggggccaaggaaccctggtcaccgtctcctcagctagc

SEQ ID NO: 2731 - DNA, 389 bp, Artificial Sequence
  gi|Fabrus|C06_VH3-23_IGHD4-4*01(1)>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttactgtagtctcctattactactactactacggtatggacgtctggggccaaggaaccctggtcaccgtctcctcagctagc

SEQ ID NO: 2732 - DNA, 389 bp, Artificial Sequence
  gi|Fabrus|C07_VH3-23_IGHD4-4*01(1)>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttactgtagttcctattactactactactacggtatggacgtctggggccaaggaaccctggtcaccgtctcctcagctagc

SEQ ID NO: 2733 - DNA, 389 bp, Artificial Sequence; identical to SEQ ID NO: 2731
  gi|Fabrus|C08_VH3-23_IGHD4-11*01(1)>1'_IGHJ6*01

SEQ ID NO: 2734 - DNA, 389 bp, Artificial Sequence; identical to SEQ ID NO: 2732
  gi|Fabrus|C09_VH3-23_IGHD4-11*01(1)>3'_IGHJ6*01

SEQ ID NO: 2735 - DNA, 389 bp, Artificial Sequence
  gi|Fabrus|C10_VH3-23_IGHD4-17*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtcaccgtagtctcctattactactactactacggtatggacgtctggggccaaggaaccctggtcaccgtctcctcagctagc

SEQ ID NO: 2736 - DNA, 389 bp, Artificial Sequence
  gi|Fabrus|C11_VH3-23_IGHD4-17*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtcaccgtagttcctattactactactactacggtatggacgtctggggccaaggaaccctggtcaccgtctcctcagctagc

SEQ ID NO: 2737 - DNA, 392 bp, Artificial Sequence
  gi|Fabrus|C12_VH3-23_IGHD4-23*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagttaccaccgtagtctcctattactactactactacggtatggacgtctggggccaaggaaccctggtcaccgtctcctcagctagc

SEQ ID NO: 2738 - DNA, 392 bp, Artificial Sequence
  gi|Fabrus|D01_VH3-23_IGHD4-23*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagttaccaccgtagttcctattactactactactacggtatggacgtctggggccaaggaaccctggtcaccgtctcctcagctagc

SEQ ID NO: 2739 - DNA, 395 bp, Artificial Sequence
  gi|Fabrus|D02_VH3-23_IGHD5-5*01(2)>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaaccatagctgtatccacgtcctattactactactactacggtatggacgtctggggccaaggaaccctggtcaccgtctcctcagctagc

SEQ ID NO: 2740 - DNA, 395 bp, Artificial Sequence
  gi|Fabrus|D03_VH3-23_IGHD5-5*01(2)>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaaccatagctgtatccactcctattactactactactacggtatggacgtctggggccaaggaaccctggtcaccgtctcctcagctagc

SEQ ID NO: 2741 - DNA, 398 bp, Artificial Sequence
  gi|Fabrus|D04_VH3-23_IGHD5-12*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaatcgtagccactatatccacgtcctattactactactactacggtatggacgtctggggccaaggaaccctggtcaccgtctcctcagctagc

SEQ ID NO: 2742 - DNA, 398 bp, Artificial Sequence
  gi|Fabrus|D05_VH3-23_IGHD5-12*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaatcgtagccactatatccactcctattactactactactacggtatggacgtctggggccaaggaaccctggtcaccgtctcctcagctagc

SEQ ID NO: 2743 - DNA, 395 bp, Artificial Sequence; identical to SEQ ID NO: 2739
  gi|Fabrus|D06_VH3-23_IGHD5-18*01(2)>1'_IGHJ6*01

SEQ ID NO: 2744 - DNA, 395 bp, Artificial Sequence; identical to SEQ ID NO: 2740
  gi|Fabrus|D07_VH3-23_IGHD5-18*01(2)>3'_IGHJ6*01

SEQ ID NO: 2745 - DNA, 395 bp, Artificial Sequence
  gi|Fabrus|D08_VH3-23_IGHD5-24*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaattgtagccatctctacgtcctattactactactactacggtatggacgtctggggccaaggaaccctggtcaccgtctcctcagctagc

SEQ ID NO: 2746 - DNA, 395 bp, Artificial Sequence
  gi|Fabrus|D09_VH3-23_IGHD5-24*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaattgtagccatctctactcctattactactactactacggtatggacgtctggggccaaggaaccctggtcaccgtctcctcagctagc

SEQ ID NO: 2747 - DNA, 392 bp, Artificial Sequence
  gi|Fabrus|D10_VH3-23_IGHD6-6*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggacgagctgctatactctcctattactactactactacggtatggacgtctggggccaaggaaccctggtcaccgtctcctcagctagc

SEQ ID NO: 2748 - DNA, 392 bp, Artificial Sequence
  gi|Fabrus|D11_VH3-23_IGHD6-6*01>2'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagacgagctgctatactcgtcctattactactactactacggtatggacgtctggggccaaggaaccctggtcaccgtctcctcagctagc

SEQ ID NO: 2749 - DNA, 392 bp, Artificial Sequence
  gi|Fabrus|D12_VH3-23_IGHD6-6*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggacgagctgctatacttcctattactactactactacggtatggacgtctggggccaaggaaccctggtcaccgtctcctcagctagc

SEQ ID NO: 2750 - DNA, 395 bp, Artificial Sequence
  gi|Fabrus|E01_VH3-23_IGHD6-13*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagctgctgctataccctcctattactactactactacggtatggacgtctggggccaaggaaccctggtcaccgtctcctcagctagc

SEQ ID NO: 2751 - DNA, 395 bp, Artificial Sequence
  gi|Fabrus|E02_VH3-23_IGHD6-13*01>2'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagctgctgctatacccgtcctattactactactactacggtatggacgtctggggccaaggaaccctggtcaccgtctcctcagctagc

SEQ ID NO: 2752 - DNA, 395 bp, Artificial Sequence
  gi|Fabrus|E03_VH3-23_IGHD6-13*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagctgctgctatacctcctattactactactactacggtatggacgtctggggccaaggaaccctggtcaccgtctcctcagctagc

SEQ ID NO: 2753 - DNA, 395 bp, Artificial Sequence
  gi|Fabrus|E04_VH3-23_IGHD6-19*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagccactgctataccctcctattactactactactacggtatggacgtctggggccaaggaaccctggtcaccgtctcctcagctagc

SEQ ID NO: 2754 - DNA, 395 bp, Artificial Sequence
  gi|Fabrus|E05_VH3-23_IGHD6-19*01>2'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagccactgctatacccgtcctattactactactactacggtatggacgtctggggccaaggaaccctggtcaccgtctcctcagctagc

SEQ ID NO: 2755 - DNA, 395 bp, Artificial Sequence
  gi|Fabrus|E06_VH3-23_IGHD6-19*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagccactgctatacctcctattactactactactacggtatggacgtctggggccaaggaaccctggtcaccgtctcctcagctagc

SEQ ID NO: 2756 - DNA, 392 bp, Artificial Sequence
  gi|Fabrus|E07_VH3-23_IGHD6-25*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagccgctgctataccctcctattactactactactacggtatggacgtctggggccaaggaaccctggtcaccgtctcctcagctagc

SEQ ID NO: 2757 - DNA, 392 bp, Artificial Sequence
  gi|Fabrus|E08_VH3-23_IGHD6-25*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagccgctgctatacctcctattactactactactacggtatggacgtctggggccaaggaaccctggtcaccgtctcctcagctagc

SEQ ID NO: 2758 - DNA, 386 bp, Artificial Sequence
  gi|Fabrus|E09_VH3-23_IGHD7-27*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatccccagttaggtcctattactactactactacggtatggacgtctggggccaaggaaccctggtcaccgtctcctcagctagc

SEQ ID NO: 2759 - DNA, 386 bp, Artificial Sequence
  gi|Fabrus|E10_VH3-23_IGHD7-27*01>2'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccccagttagggtcctattactactactactacggtatggacgtctggggccaaggaaccctggtcaccgtctcctcagctagc

SEQ ID NO: 2760 - protein, 125 aa, Artificial Sequence
  VH3-23_IGHD1-1*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTTGTTSYAEYFQHWGQGTLVTVSSAS

SEQ ID NO: 2761 - protein, 125 aa, Artificial Sequence
  VH3-23_IGHD1-1*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVQLERRSYAEYFQHWGQGTLVTVSSAS

SEQ ID NO: 2762 - protein, 125 aa, Artificial Sequence
  VH3-23_IGHD1-1*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNDSYAEYFQHWGQGTLVTVSSAS

SEQ ID NO: 2763 - protein, 125 aa, Artificial Sequence
  VH3-23_IGHD1-7*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITGTTSYAEYFQHWGQGTLVTVSSAS

SEQ ID NO: 2764 - protein, 125 aa, Artificial Sequence
  VH3-23_IGHD1-7*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNYSYAEYFQHWGQGTLVTVSSAS

SEQ ID NO: 2765 - protein, 125 aa, Artificial Sequence; identical to SEQ ID NO: 2763
  VH3-23_IGHD1-14*01>1_IGHJ1*01

SEQ ID NO: 2766 - protein, 125 aa, Artificial Sequence
  VH3-23_IGHD1-14*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNRNHSYAEYFQHWGQGTLVTVSSAS

SEQ ID NO: 2767 - protein, 125 aa, Artificial Sequence; identical to SEQ ID NO: 2763
  VH3-23_IGHD1-20*01>1_IGHJ1*01

SEQ ID NO: 2768 - protein, 125 aa, Artificial Sequence; identical to SEQ ID NO: 2762
  VH3-23_IGHD1-20*01>3_IGHJ1*01

SEQ ID NO: 2769 - protein, 126 aa, Artificial Sequence
  VH3-23_IGHD1-26*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIVGATTSYAEYFQHWGQGTLVTVSSAS

SEQ ID NO: 2770 - protein, 126 aa, Artificial Sequence
  VH3-23_IGHD1-26*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSGSYYSYAEYFQHWGQGTLVTVSSAS

SEQ ID NO: 2771 - protein, 129 aa, Artificial Sequence
  VH3-23_IGHD2-2*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSSTSCYASYAEYFQHWGQGTLVTVSSAS

SEQ ID NO: 2772 - protein, 129 aa, Artificial Sequence
  VH3-23_IGHD2-2*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVPAAMSYAEYFQHWGQGTLVTVSSAS

SEQ ID NO: 2773 - protein, 129 aa, Artificial Sequence
  VH3-23_IGHD2-8*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCTNGVCYTSYAEYFQHWGQGTLVTVSSAS

SEQ ID NO: 2774 - protein, 129 aa, Artificial Sequence
  VH3-23_IGHD2-8*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVLMVYAISYAEYFQHWGQGTLVTVSSAS

SEQ ID NO: 2775 - protein, 129 aa, Artificial Sequence
  VH3-23_IGHD2-15*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSGGSCYSSYAEYFQHWGQGTLVTVSSAS

SEQ ID NO: 2776 - protein, 129 aa, Artificial Sequence
  VH3-23_IGHD2-15*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVVAATSYAEYFQHWGQGTLVTVSSAS

SEQ ID NO: 2777 - protein, 128 aa, Artificial Sequence
  VH3-23_IGHD2-21*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKAYCGGDCYSSYAEYFQHWGQGTLVTVSSAS

SEQ ID NO: 2778 - protein, 128 aa, Artificial Sequence
  VH3-23_IGHD2-21*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVIAISYAEYFQHWGQGTLVTVSSAS

SEQ ID NO: 2779 - protein, 129 aa, Artificial Sequence
  VH3-23_IGHD3-3*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVLRFLEWLLYSYAEYFQHWGQGTLVTVSSAS

SEQ ID NO: 2780 - protein, 129 aa, Artificial Sequence
  VH3-23_IGHD3-3*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDFWSGYYTSYAEYFQHWGQGTLVTVSSAS

SEQ ID NO: 2781 - protein, 129 aa, Artificial Sequence
  VH3-23_IGHD3-3*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITIFGVVIISYAEYFQHWGQGTLVTVSSAS

SEQ ID NO: 2782 - protein, 129 aa, Artificial Sequence
  VH3-23_IGHD3-9*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDILTGYYNSYAEYFQHWGQGTLVTVSSAS

SEQ ID NO: 2783 - protein, 129 aa, Artificial Sequence
  VH3-23_IGHD3-10*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYGSGSYYNSYAEYFQHWGQGTLVTVSSAS

SEQ ID NO: 2784 - protein, 129 aa, Artificial Sequence
  VH3-23_IGHD3-10*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYAEYFQHWGQGTLVTVSSAS

SEQ ID NO: 2785 - protein, 131 aa, Artificial Sequence
  VH3-23_IGHD3-16*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDYVWGSYAYTSYAEYFQHWGQGTLVTVSSAS

SEQ ID NO: 2786 - protein, 131 aa, Artificial Sequence
  VH3-23_IGHD3-16*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIMITFGGVMLISYAEYFQHWGQGTLVTVSSAS

SEQ ID NO: 2787 - protein, 129 aa, Artificial Sequence
  VH3-23_IGHD3-22*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYDSSGYYYSYAEYFQHWGQGTLVTVSSAS

SEQ ID NO: 2788 - protein, 129 aa, Artificial Sequence
  VH3-23_IGHD3-22*01>3_IGHJ1*
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMIVVVITSYAEYFQHWGQGTLVTVSSAS

SEQ ID NO: 2789 - protein, 124 aa, Artificial Sequence
  VH3-23_IGHD4-4*01(1)_1>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYSNYSYAEYFQHWGQGTLVTVSSAS

SEQ ID NO: 2790 - protein, 124 aa, Artificial Sequence
  VH3-23_IGHD4-4*01(1)_1>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVTSYAEYFQHWGQGTLVTVSSAS

SEQ ID NO: 2791 - protein, 124 aa, Artificial Sequence; identical to SEQ ID NO: 2789
  VH3-23_IGHD4-11*01(1)_1>2_IGHJ1*01

SEQ ID NO: 2792 - protein, 124 aa, Artificial Sequence; identical to SEQ ID NO: 2790
  VH3-23_IGHD4-11*01(1)_1>3_IGHJ1*01

SEQ ID NO: 2793 - protein, 124 aa, Artificial Sequence
  VH3-23_IGHD4-17*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGDYSYAEYFQHWGQGTLVTVSSAS

SEQ ID NO: 2794 - protein, 124 aa, Artificial Sequence; identical to SEQ ID NO: 2790
  VH3-23_IGHD4-17*01>3_IGHJ1*01

SEQ ID NO: 2795 - protein, 125 aa, Artificial Sequence
  VH3-23_IGHD4-23*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGGNSSYAEYFQHWGQGTLVTVSSAS

SEQ ID NO: 2796 - protein, 125 aa, Artificial Sequence
  VH3-23_IGHD4-23*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVVTSYAEYFQHWGQGTLVTVSSAS

SEQ ID NO: 2797 - protein, 126 aa, Artificial Sequence
  VH3-23_IGHD5-5*01(2)_1>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDTAMVTSYAEYFQHWGQGTLVTVSSAS

SEQ ID NO: 2798 - protein, 126 aa, Artificial Sequence
  VH3-23_IGHD5-5*01(2)_1>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWIQLWLRSYAEYFQHWGQGTLVTVSSAS

SEQ ID NO: 2799 - protein, 126 aa, Artificial Sequence
  VH3-23_IGHD5-5*01(2)_1>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSYGYSYAEYFQHWGQGTLVTVSSAS

SEQ ID NO: 2800 - protein, 127 aa, Artificial Sequence
  VH3-23_IGHD5-12*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDIVATITSYAEYFQHWGQGTLVTVSSAS

SEQ ID NO: 2801 - protein, 127 aa, Artificial Sequence
  VH3-23_IGHD5-12*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSGYDYSYAEYFQHWGQGTLVTVSSAS

SEQ ID NO: 2802 - protein, 126 aa, Artificial Sequence; identical to SEQ ID NO: 2797
  VH3-23_IGHD5-18*01(2)_1>1_IGHJ1*01

SEQ ID NO: 2803 - protein, 126 aa, Artificial Sequence; identical to SEQ ID NO: 2798
  VH3-23_IGHD5-18*01(2)_1>2_IGHJ1*01

SEQ ID NO: 2804 - protein, 126 aa, Artificial Sequence; identical to SEQ ID NO: 2799
  VH3-23_IGHD5-18*01(2)_1>3_IGHJ1*01

SEQ ID NO: 2805 - protein, 126 aa, Artificial Sequence
  VH3-23_IGHD5-24*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVEMATITSYAEYFQHWGQGTLVTVSSAS

SEQ ID NO: 2806 - protein, 126 aa, Artificial Sequence
  VH3-23_IGHD5-24*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRDGYNYSYAEYFQHWGQGTLVTVSSAS

SEQ ID NO: 2807 - protein, 125 aa, Artificial Sequence
  VH3-23_IGHD6-6*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEYSSSSSYAEYFQHWGQGTLVTVSSAS

SEQ ID NO: 2808 - protein, 125 aa, Artificial Sequence
  VH3-23_IGHD6-6*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSIAARPSYAEYFQHWGQGTLVTVSSAS

SEQ ID NO: 2809 - protein, 126 aa, Artificial Sequence
  VH3-23_IGHD6-13*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSSWYSYAEYFQHWGQGTLVTVSSAS

SEQ ID NO: 2810 - protein, 126 aa, Artificial Sequence
  VH3-23_IGHD6-13*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAAGTSYAEYFQHWGQGTLVTVSSAS

SEQ ID NO: 2811 - protein, 126 aa, Artificial Sequence
  VH3-23_IGHD6-19*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGWYSYAEYFQHWGQGTLVTVSSAS

SEQ ID NO: 2812 - protein, 126 aa, Artificial Sequence
  VH3-23_IGHD6-19*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAVAGTSYAEYFQHWGQGTLVTVSSAS

SEQ ID NO: 2813 - protein, 125 aa, Artificial Sequence
  VH3-23_IGHD6-25*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGYSYAEYFQHWGQGTLVTVSSAS

SEQ ID NO: 2814 - protein, 125 aa, Artificial Sequence
  VH3-23_IGHD6-25*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAATSYAEYFQHWGQGTLVTVSSAS

SEQ ID NO: 2815 - protein, 123 aa, Artificial Sequence
  VH3-23_IGHD7-27*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKLTGESYAEYFQHWGQGTLVTVSSAS

SEQ ID NO: 2816 - protein, 123 aa, Artificial Sequence
  VH3-23_IGHD7-27*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKANWGSYAEYFQHWGQGTLVTVSSAS

SEQ ID NO: 2817 - protein, 125 aa, Artificial Sequence
  VH3-23_IGHD1-1*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVVPSYAEYFQHWGQGTLVTVSSAS

SEQ ID NO: 2818 - protein, 125 aa, Artificial Sequence
  VH3-23_IGHD1-1*01>2'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSFQLYRSYAEYFQHWGQGTLVTVSSAS

SEQ ID NO: 2819 - protein, 125 aa, Artificial Sequence
  VH3-23_IGHD1-1*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSCTSYAEYFQHWGQGTLVTVSSAS

SEQ ID NO: 2820 - protein, 125 aa, Artificial Sequence
  VH3-23_IGHD1-7*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVIPSYAEYFQHWGQGTLVTVSSAS

SEQ ID NO: 2821 - protein, 125 aa, Artificial Sequence
  VH3-23_IGHD1-7*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYTSYAEYFQHWGQGTLVTVSSAS

SEQ ID NO: 2822 - protein, 125 aa, Artificial Sequence; identical to SEQ ID NO: 2820
  VH3-23_IGHD1-14*01>1'_IGHJ1*01

SEQ ID NO: 2823 - protein, 125 aa, Artificial Sequence
  VH3-23_IGHD1-14*01>2'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWFRLYRSYAEYFQHWGQGTLVTVSSAS

SEQ ID NO: 2824 - protein, 125 aa, Artificial Sequence
  VH3-23_IGHD1-14*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGSGYTSYAEYFQHWGQGTLVTVSSAS

SEQ ID NO: 2825 - protein, 125 aa, Artificial Sequence; identical to SEQ ID NO: 2820
  VH3-23_IGHD1-20*01>1'_IGHJ1*01

SEQ ID NO: 2826 - protein, 125 aa, Artificial Sequence; identical to SEQ ID NO: 2818
  VH3-23_IGHD1-20*01>2'_IGHJ1*01

SEQ ID NO: 2827 - protein, 125 aa, Artificial Sequence
  VH3-23_IGHD1-20*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSYTSYAEYFQHWGQGTLVTVSSAS

SEQ ID NO: 2828 - protein, 126 aa, Artificial Sequence
  VH3-23_IGHD1-26*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVAPTIPSYAEYFQHWGQGTLVTVSSAS

SEQ ID NO: 2829 - protein, 126 aa, Artificial Sequence
  VH3-23_IGHD1-26*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSHYTSYAEYFQHWGQGTLVTVSSAS

SEQ ID NO: 2830 - protein, 129 aa, Artificial Sequence
  VH3-23_IGHD2-2*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAGTTTISSYAEYFQHWGQGTLVTVSSAS

SEQ ID NO: 2831 - protein, 129 aa, Artificial Sequence
  VH3-23_IGHD2-2*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGHSSWYYYNISYAEYFQHWGQGTLVTVSSAS

SEQ ID NO: 2832 - protein, 129 aa, Artificial Sequence
  VH3-23_IGHD2-8*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAYTISTISSYAEYFQHWGQGTLVTVSSAS

SEQ ID NO: 2833 - protein, 129 aa, Artificial Sequence
  VH3-23_IGHD2-15*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVAATTTTISSYAEYFQHWGQGTLVTVSSAS

SEQ ID NO: 2834 - protein, 129 aa, Artificial Sequence
  VH3-23_IGHD2-15*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYHHYNISYAEYFQHWGQGTLVTVSSAS

SEQ ID NO: 2835 - protein, 128 aa, Artificial Sequence
  VH3-23_IGHD2-21*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAITTTICSYAEYFQHWGQGTLVTVSSAS

SEQ ID NO: 2836 - protein, 128 aa, Artificial Sequence
  VH3-23_IGHD2-21*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNSNHHHNMSYAEYFQHWGQGTLVTVSSAS

SEQ ID NO: 2837 - protein, 129 aa, Artificial Sequence
  VH3-23_IGHD3-3*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIITTPKIVISYAEYFQHWGQGTLVTVSSAS

SEQ ID NO: 2838 - protein, 129 aa, Artificial Sequence
  VH3-23_IGHD3-3*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNHSKNRNSYAEYFQHWGQGTLVTVSSAS

SEQ ID NO: 2839 - protein, 129 aa, Artificial Sequence
  VH3-23_IGHD3-9*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITSQNIVISYAEYFQHWGQGTLVTVSSAS

SEQ ID NO: 2840 - protein, 129 aa, Artificial Sequence
  VH3-23_IGHD3-9*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNQSKYRNSYAEYFQHWGQGTLVTVSSAS

SEQ ID NO: 2841 - protein, 129 aa, Artificial Sequence
  VH3-23_IGHD3-10*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITPRTIVISYAEYFQHWGQGTLVTVSSAS

SEQ ID NO: 2842 - protein, 129 aa, Artificial Sequence
  VH3-23_IGHD3-10*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNSPNHSNSYAEYFQHWGQGTLVTVSSAS

SEQ ID NO: 2843 - protein, 131 aa, Artificial Sequence
  VH3-23_IGHD3-16*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGISITPPNVIIISYAEYFQHWGQGTLVTVSSAS

SEQ ID NO: 2844 - protein, 131 aa, Artificial Sequence
  VH3-23_IGHD3-16*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYKHNSPKRNHNSYAEYFQHWGQGTLVTVSSAS

SEQ ID NO: 2845 - protein, 129 aa, Artificial Sequence
  VH3-23_IGHD3-22*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVITTTIIVISYAEYFQHWGQGTLVTVSSAS

SEQ ID NO: 2846 - protein, 124 aa, Artificial Sequence
  VH3-23_IGHD4-4*01(1)_1>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVTVVSYAEYFQHWGQGTLVTVSSAS

SEQ ID NO: 2847 - protein, 124 aa, Artificial Sequence
  VH3-23_IGHD4-4*01(1)_1>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYCSSYAEYFQHWGQGTLVTVSSAS

SEQ ID NO: 2848 - protein, 124 aa, Artificial Sequence; identical to SEQ ID NO: 2846
  VH3-23_IGHD4-11*01(1)_1>1'_IGHJ1*01

SEQ ID NO: 2849 - protein, 124 aa, Artificial Sequence; identical to SEQ ID NO: 2847
  VH3-23_IGHD4-11*01(1)_1>3'_IGHJ1*01

SEQ ID NO: 2850 - protein, 124 aa, Artificial Sequence; identical to SEQ ID NO: 2846
  VH3-23_IGHD4-17*01>1'_IGHJ1*01

SEQ ID NO: 2851 - protein, 124 aa, Artificial Sequence
  VH3-23_IGHD4-17*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSHRSSYAEYFQHWGQGTLVTVSSAS

SEQ ID NO: 2852 - protein, 125 aa, Artificial Sequence
  VH3-23_IGHD4-23*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVTTVVSYAEYFQHWGQGTLVTVSSAS

SEQ ID NO: 2853 - protein, 125 aa, Artificial Sequence
  VH3-23_IGHD4-23*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYHRSSYAEYFQHWGQGTLVTVSSAS

SEQ ID NO: 2854 - protein, 126 aa, Artificial Sequence
  VH3-23_IGHD5-5*01(2)_1>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTIAVSTSYAEYFQHWGQGTLVTVSSAS

SEQ ID NO: 2855 - protein, 126 aa, Artificial Sequence
  VH3-23_IGHD5-5*01(2)_1>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNHSCIHSYAEYFQHWGQGTLVTVSSAS

SEQ ID NO: 2856 - protein, 127 aa, Artificial Sequence
  VH3-23_IGHD5-12*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVATISTSYAEYFQHWGQGTLVTVSSAS

SEQ ID NO: 2857 - protein, 127 aa, Artificial Sequence
  VH3-23_IGHD5-12*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNRSHYIHSYAEYFQHWGQGTLVTVSSAS

SEQ ID NO: 2858 - protein, 126 aa, Artificial Sequence; identical to SEQ ID NO: 2854
  VH3-23_IGHD5-18*01(2)_1>1'_IGHJ1*01

SEQ ID NO: 2859 - protein, 126 aa, Artificial Sequence; identical to SEQ ID NO: 2855
  VH3-23_IGHD5-18*01(2)_1>3'_IGHJ1*01

SEQ ID NO: 2860 - protein, 126 aa, Artificial Sequence
  VH3-23_IGHD5-24*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVAISTSYAEYFQHWGQGTLVTVSSAS

SEQ ID NO: 2861 - protein, 126 aa, Artificial Sequence
  VH3-23_IGHD5-24*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNCSHLYSYAEYFQHWGQGTLVTVSSAS

SEQ ID NO: 2862 - protein, 125 aa, Artificial Sequence
  VH3-23_IGHD6-6*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRAAILSYAEYFQHWGQGTLVTVSSAS

SEQ ID NO: 2863 - protein, 125 aa, Artificial Sequence
  VH3-23_IGHD6-6*01>2'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDELLYSSYAEYFQHWGQGTLVTVSSAS

SEQ ID NO: 2864 - protein, 125 aa, Artificial Sequence
  VH3-23_IGHD6-6*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCYTSYAEYFQHWGQGTLVTVSSAS

SEQ ID NO: 2865 - protein, 126 aa, Artificial Sequence
  VH3-23_IGHD6-13*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPAAAIPSYAEYFQHWGQGTLVTVSSAS

SEQ ID NO: 2866 - protein, 126 aa, Artificial Sequence
  VH3-23_IGHD6-13*01>2'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQLLLYPSYAEYFQHWGQGTLVTVSSAS

SEQ ID NO: 2867 - protein, 126 aa, Artificial Sequence
  VH3-23_IGHD6-13*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCCYTSYAEYFQHWGQGTLVTVSSAS

SEQ ID NO: 2868 - protein, 126 aa, Artificial Sequence
  VH3-23_IGHD6-19*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPATAIPSYAEYFQHWGQGTLVTVSSAS

SEQ ID NO: 2869 - protein, 126 aa, Artificial Sequence
  VH3-23_IGHD6-19*01>2'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQPLLYPSYAEYFQHWGQGTLVTVSSAS

SEQ ID NO: 2870 - protein, 126 aa, Artificial Sequence
  VH3-23_IGHD6-19*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSHCYTSYAEYFQHWGQGTLVTVSSAS

SEQ ID NO: 2871 - protein, 125 aa, Artificial Sequence
  VH3-23_IGHD6-25*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVAAAIPSYAEYFQHWGQGTLVTVSSAS

SEQ ID NO: 2872 - protein, 125 aa, Artificial Sequence
  VH3-23_IGHD6-25*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSRCYTSYAEYFQHWGQGTLVTVSSAS

SEQ ID NO: 2873 - protein, 123 aa, Artificial Sequence
  VH3-23_IGHD7-27*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSPVRSYAEYFQHWGQGTLVTVSSAS

SEQ ID NO: 2874 - protein, 123 aa, Artificial Sequence
  VH3-23_IGHD7-27*01>2'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKPQLGSYAEYFQHWGQGTLVTVSSAS

SEQ ID NO: 2875 - protein, 125 aa, Artificial Sequence
  VH3-23_IGHD1-1*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTTGTTSYYWYFDSWGQGTLVTVSSAS

SEQ ID NO: 2876 - protein, 125 aa, Artificial Sequence
  VH3-23_IGHD1-1*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVQLERRSYYWYFDSWGQGTLVTVSSAS

SEQ ID NO: 2877 - protein, 125 aa, Artificial Sequence
  VH3-23_IGHD1-1*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNDSYYWYFDSWGQGTLVTVSSAS

SEQ ID NO: 2878 - protein, 125 aa, Artificial Sequence
  VH3-23_IGHD1-7*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITGTTSYYWYFDSWGQGTLVTVSSAS

SEQ ID NO: 2879 - protein, 125 aa, Artificial Sequence
  VH3-23_IGHD1-7*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNYSYYWYFDSWGQGTLVTVSSAS

SEQ ID NO: 2880 - protein, 125 aa, Artificial Sequence; identical to SEQ ID NO: 2878
  VH3-23_IGHD1-14*01>1_IGHJ2*01

SEQ ID NO: 2881 - protein, 125 aa, Artificial Sequence
  VH3-23_IGHD1-14*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNRNHSYYWYFDSWGQGTLVTVSSAS

SEQ ID NO: 2882 - protein, 125 aa, Artificial Sequence; identical to SEQ ID NO: 2878
  VH3-23_IGHD1-20*01>1_IGHJ2*01

SEQ ID NO: 2883 - protein, 125 aa, Artificial Sequence; identical to SEQ ID NO: 2877
  VH3-23_IGHD1-20*01>3_IGHJ2*01

SEQ ID NO: 2884 - protein, 126 aa, Artificial Sequence
  VH3-23_IGHD1-26*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIVGATTSYYWYFDSWGQGTLVTVSSAS

SEQ ID NO: 2885 - protein, 126 aa, Artificial Sequence
  VH3-23_IGHD1-26*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSGSYYSYYWYFDSWGQGTLVTVSSAS

SEQ ID NO: 2886 - protein, 129 aa, Artificial Sequence
  VH3-23_IGHD2-2*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSSTSCYASYYWYFDSWGQGTLVTVSSAS

SEQ ID NO: 2887 - protein, 129 aa, Artificial Sequence
  VH3-23_IGHD2-2*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVPAAMSYYWYFDSWGQGTLVTVSSAS

SEQ ID NO: 2888 - protein, 129 aa, Artificial Sequence
  VH3-23_IGHD2-8*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCTNGVCYTSYYWYFDSWGQGTLVTVSSAS

SEQ ID NO: 2889 - protein, 129 aa, Artificial Sequence
  VH3-23_IGHD2-8*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVLMVYAISYYWYFDSWGQGTLVTVSSAS

SEQ ID NO: 2890 - protein, 129 aa, Artificial Sequence
  VH3-23_IGHD2-15*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSGGSCYSSYYWYFDSWGQGTLVTVSSAS

SEQ ID NO: 2891 - protein, 129 aa, Artificial Sequence
  VH3-23_IGHD2-15*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVVAATSYYWYFDSWGQGTLVTVSSAS

SEQ ID NO: 2892 - protein, 128 aa, Artificial Sequence
  VH3-23_IGHD2-21*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKAYCGGDCYSSYYWYFDSWGQGTLVTVSSAS

SEQ ID NO: 2893 - protein, 128 aa, Artificial Sequence
  VH3-23_IGHD2-21*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVIAISYYWYFDSWGQGTLVTVSSAS

SEQ ID NO: 2894 - protein, 129 aa, Artificial Sequence
  VH3-23_IGHD3-3*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVLRFLEWLLYSYYWYFDSWGQGTLVTVSSAS

SEQ ID NO: 2895 - protein, 129 aa, Artificial Sequence
  VH3-23_IGHD3-3*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDFWSGYYTSYYWYFDSWGQGTLVTVSSAS

SEQ ID NO: 2896 - protein, 129 aa, Artificial Sequence
  VH3-23_IGHD3-3*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITIFGVVIISYYWYFDSWGQGTLVTVSSAS

SEQ ID NO: 2897 - protein, 129 aa, Artificial Sequence
  VH3-23_IGHD3-9*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDILTGYYNSYYWYFDSWGQGTLVTVSSAS

SEQ ID NO: 2898 - protein, 129 aa, Artificial Sequence
  VH3-23_IGHD3-10*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYGSGSYYNSYYWYFDSWGQGTLVTVSSAS

SEQ ID NO: 2899 - protein, 129 aa, Artificial Sequence
  VH3-23_IGHD3-10*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYWYFDSWGQGTLVTVSSAS

SEQ ID NO: 2900 - protein, 131 aa, Artificial Sequence
  VH3-23_IGHD3-16*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDYVWGSYAYTSYYWYFDSWGQGTLVTVSSAS

SEQ ID NO: 2901 - protein, 131 aa, Artificial Sequence
  VH3-23_IGHD3-16*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIMITFGGVMLISYYWYFDSWGQGTLVTVSSAS

SEQ ID NO: 2902 - protein, 129 aa, Artificial Sequence
  VH3-23_IGHD3-22*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYDSSGYYYSYYWYFDSWGQGTLVTVSSAS

SEQ ID NO: 2903 - protein, 129 aa, Artificial Sequence
  VH3-23_IGHD3-22*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMIVVVITSYYWYFDSWGQGTLVTVSSAS

SEQ ID NO: 2904 - protein, 124 aa, Artificial Sequence
  VH3-23_IGHD4-4*01(1)_1>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYSNYSYYWYFDSWGQGTLVTVSSAS

SEQ ID NO: 2905 - protein, 124 aa, Artificial Sequence
  VH3-23_IGHD4-4*01(1)_1>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVTSYYWYFDSWGQGTLVTVSSAS

SEQ ID NO: 2906 - protein, 124 aa, Artificial Sequence; identical to SEQ ID NO: 2904
  VH3-23_IGHD4-11*01(1)_1>2_IGHJ2*01

SEQ ID NO: 2907 - protein, 124 aa, Artificial Sequence; identical to SEQ ID NO: 2905
  VH3-23_IGHD4-11*01(1)_1>3_IGHJ2*01

SEQ ID NO: 2908 - protein, 124 aa, Artificial Sequence
  VH3-23_IGHD4-17*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGDYSYYWYFDSWGQGTLVTVSSAS

SEQ ID NO: 2909 - protein, 124 aa, Artificial Sequence; identical to SEQ ID NO: 2905
  VH3-23_IGHD4-17*01>3_IGHJ2*01

SEQ ID NO: 2910 - protein, 125 aa, Artificial Sequence
  VH3-23_IGHD4-23*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGGNSSYYWYFDSWGQGTLVTVSSAS

SEQ ID NO: 2911 - protein, 125 aa, Artificial Sequence
  VH3-23_IGHD4-23*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVVTSYYWYFDSWGQGTLVTVSSAS

SEQ ID NO: 2912 - protein, 126 aa, Artificial Sequence
  VH3-23_IGHD5-5*01(2)_1>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDTAMVTSYYWYFDSWGQGTLVTVSSAS

SEQ ID NO: 2913 - protein, 126 aa, Artificial Sequence
  VH3-23_IGHD5-5*01(2)_1>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWIQLWLRSYYWYFDSWGQGTLVTVSSAS

SEQ ID NO: 2914 - protein, 126 aa, Artificial Sequence
  VH3-23_IGHD5-5*01(2)_1>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSYGYSYYWYFDSWGQGTLVTVSSAS

SEQ ID NO: 2915 - protein, 127 aa, Artificial Sequence
  VH3-23_IGHD5-12*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDIVATITSYYWYFDSWGQGTLVTVSSAS

SEQ ID NO: 2916 - protein, 127 aa, Artificial Sequence
  VH3-23_IGHD5-12*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSGYDYSYYWYFDSWGQGTLVTVSSAS

SEQ ID NO: 2917 - protein, 126 aa, Artificial Sequence; identical to SEQ ID NO: 2912
  VH3-23_IGHD5-18*01(2)_1>1_IGHJ2*01

SEQ ID NO: 2918 - protein, 126 aa, Artificial Sequence; identical to SEQ ID NO: 2913
  VH3-23_IGHD5-18*01(2)_1>2_IGHJ2*01

SEQ ID NO: 2919 - protein, 126 aa, Artificial Sequence; identical to SEQ ID NO: 2914
  VH3-23_IGHD5-18*01(2)_1>3_IGHJ2*01

SEQ ID NO: 2920 - protein, 126 aa, Artificial Sequence
  VH3-23_IGHD5-24*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVEMATITSYYWYFDSWGQGTLVTVSSAS

SEQ ID NO: 2921 - protein, 126 aa, Artificial Sequence
  VH3-23_IGHD5-24*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRDGYNYSYYWYFDSWGQGTLVTVSSAS

SEQ ID NO: 2922 - protein, 125 aa, Artificial Sequence
  VH3-23_IGHD6-6*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEYSSSSSYYWYFDSWGQGTLVTVSSAS

SEQ ID NO: 2923 - protein, 125 aa, Artificial Sequence
  VH3-23_IGHD6-6*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSIAARPSYYWYFDSWGQGTLVTVSSAS

SEQ ID NO: 2924 - protein, 126 aa, Artificial Sequence
  VH3-23_IGHD6-13*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSSWYSYYWYFDSWGQGTLVTVSSAS

SEQ ID NO: 2925 - protein, 126 aa, Artificial Sequence
  VH3-23_IGHD6-13*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAAGTSYYWYFDSWGQGTLVTVSSAS

SEQ ID NO: 2926 - protein, 126 aa, Artificial Sequence
  VH3-23_IGHD6-19*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGWYSYYWYFDSWGQGTLVTVSSAS

SEQ ID NO: 2927 - protein, 126 aa, Artificial Sequence
  VH3-23_IGHD6-19*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAVAGTSYYWYFDSWGQGTLVTVSSAS

SEQ ID NO: 2928 - protein, 125 aa, Artificial Sequence
  VH3-23_IGHD6-25*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGYSYYWYFDSWGQGTLVTVSSAS

SEQ ID NO: 2929 - protein, 125 aa, Artificial Sequence
  VH3-23_IGHD6-25*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAATSYYWYFDSWGQGTLVTVSSAS

SEQ ID NO: 2930 - protein, 123 aa, Artificial Sequence
  VH3-23_IGHD7-27*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKLTGESYYWYFDSWGQGTLVTVSSAS

SEQ ID NO: 2931 - protein, 123 aa, Artificial Sequence
  VH3-23_IGHD7-27*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKANWGSYYWYFDSWGQGTLVTVSSAS

SEQ ID NO: 2932 - protein, 125 aa, Artificial Sequence
  VH3-23_IGHD1-1*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVVPSYYWYFDSWGQGTLVTVSSAS

SEQ ID NO: 2933 - protein, 125 aa, Artificial Sequence
  VH3-23_IGHD1-1*01>2'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSFQLYRSYYWYFDSWGQGTLVTVSSAS

SEQ ID NO: 2934 - protein, 125 aa, Artificial Sequence
  VH3-23_IGHD1-1*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSCTSYYWYFDSWGQGTLVTVSSAS

SEQ ID NO: 2935 - protein, 125 aa, Artificial Sequence
  VH3-23_IGHD1-7*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVIPSYYWYFDSWGQGTLVTVSSAS

SEQ ID NO: 2936 - protein, 125 aa, Artificial Sequence
  VH3-23_IGHD1-7*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYTSYYWYFDSWGQGTLVTVSSAS

SEQ ID NO: 2937 - protein, 125 aa, Artificial Sequence; identical to SEQ ID NO: 2935
  VH3-23_IGHD1-14*01>1'_IGHJ2*01

SEQ ID NO: 2938 - protein, 125 aa, Artificial Sequence
  VH3-23_IGHD1-14*01>2'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWFRLYRSYYWYFDSWGQGTLVTVSSAS

SEQ ID NO: 2939 - protein, 125 aa, Artificial Sequence
  VH3-23_IGHD1-14*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGSGYTSYYWYFDSWGQGTLVTVSSAS

SEQ ID NO: 2940 - protein, 125 aa, Artificial Sequence; identical to SEQ ID NO: 2935
  VH3-23_IGHD1-20*01>1'_IGHJ2*01

SEQ ID NO: 2941 - protein, 125 aa, Artificial Sequence; identical to SEQ ID NO: 2933
  VH3-23_IGHD1-20*01>2'_IGHJ2*01

SEQ ID NO: 2942 - protein, 125 aa, Artificial Sequence
  VH3-23_IGHD1-20*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSYTSYYWYFDSWGQGTLVTVSSAS

SEQ ID NO: 2943 - protein, 126 aa, Artificial Sequence
  VH3-23_IGHD1-26*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVAPTIPSYYWYFDSWGQGTLVTVSSAS

SEQ ID NO: 2944 - protein, 126 aa, Artificial Sequence
  VH3-23_IGHD1-26*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSHYTSYYWYFDSWGQGTLVTVSSAS

SEQ ID NO: 2945 - protein, 129 aa, Artificial Sequence
  VH3-23_IGHD2-2*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAGTTTISSYYWYFDSWGQGTLVTVSSAS

SEQ ID NO: 2946 - protein, 129 aa, Artificial Sequence
  VH3-23_IGHD2-2*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGHSSWYYYNISYYWYFDSWGQGTLVTVSSAS

SEQ ID NO: 2947 - protein, 129 aa, Artificial Sequence
  VH3-23_IGHD2-8*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAYTISTISSYYWYFDSWGQGTLVTVSSAS

SEQ ID NO: 2948 - protein, 129 aa, Artificial Sequence
  VH3-23_IGHD2-15*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVAATTTTISSYYWYFDSWGQGTLVTVSSAS

SEQ ID NO: 2949 - protein, 129 aa, Artificial Sequence
  VH3-23_IGHD2-15*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYHHYNISYYWYFDSWGQGTLVTVSSAS

SEQ ID NO: 2950 - protein, 128 aa, Artificial Sequence
  VH3-23_IGHD2-21*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAITTTICSYYWYFDSWGQGTLVTVSSAS

SEQ ID NO: 2951 - protein, 128 aa, Artificial Sequence
  VH3-23_IGHD2-21*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNSNHHHNMSYYWYFDSWGQGTLVTVSSAS

SEQ ID NO: 2952 - protein, 129 aa, Artificial Sequence
  VH3-23_IGHD3-3*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIITTPKIVISYYWYFDSWGQGTLVTVSSAS

SEQ ID NO: 2953 - protein, 129 aa, Artificial Sequence
  VH3-23_IGHD3-3*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNHSKNRNSYYWYFDSWGQGTLVTVSSAS

SEQ ID NO: 2954 - protein, 129 aa, Artificial Sequence
  VH3-23_IGHD3-9*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITSQNIVISYYWYFDSWGQGTLVTVSSAS

SEQ ID NO: 2955 - protein, 129 aa, Artificial Sequence
  VH3-23_IGHD3-9*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNQSKYRNSYYWYFDSWGQGTLVTVSSAS

SEQ ID NO: 2956 - protein, 129 aa, Artificial Sequence
  VH3-23_IGHD3-10*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITPRTIVISYYWYFDSWGQGTLVTVSSAS

SEQ ID NO: 2957 - protein, 129 aa, Artificial Sequence
  VH3-23_IGHD3-10*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNSPNHSNSYYWYFDSWGQGTLVTVSSAS

SEQ ID NO: 2958 - protein, 131 aa, Artificial Sequence
  VH3-23_IGHD3-16*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGISITPPNVIIISYYWYFDSWGQGTLVTVSSAS

SEQ ID NO: 2959 - protein, 131 aa, Artificial Sequence
  VH3-23_IGHD3-16*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYKHNSPKRNHNSYYWYFDSWGQGTLVTVSSAS

SEQ ID NO: 2960 - protein, 129 aa, Artificial Sequence
  VH3-23_IGHD3-22*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVITTTIIVISYYWYFDSWGQGTLVTVSSAS

SEQ ID NO: 2961 - protein, 124 aa, Artificial Sequence
  VH3-23_IGHD4-4*01(1)_1>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVTVVSYYWYFDSWGQGTLVTVSSAS

SEQ ID NO: 2962 - protein, 124 aa, Artificial Sequence
  VH3-23_IGHD4-4*01(1)_1>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYCSSYYWYFDSWGQGTLVTVSSAS

SEQ ID NO: 2963 - protein, 124 aa, Artificial Sequence; identical to SEQ ID NO: 2961
  VH3-23_IGHD4-11*01(1)_1>1'_IGHJ2*01

SEQ ID NO: 2964 - protein, 124 aa, Artificial Sequence; identical to SEQ ID NO: 2962
  VH3-23_IGHD4-11*01(1)_1>3'_IGHJ2*01

SEQ ID NO: 2965 - protein, 124 aa, Artificial Sequence; identical to SEQ ID NO: 2961
  VH3-23_IGHD4-17*01>1'_IGHJ2*01

SEQ ID NO: 2966 - protein, 124 aa, Artificial Sequence
  VH3-23_IGHD4-17*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSHRSSYYWYFDSWGQGTLVTVSSAS

SEQ ID NO: 2967 - protein, 125 aa, Artificial Sequence
  VH3-23_IGHD4-23*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVTTVVSYYWYFDSWGQGTLVTVSSAS

SEQ ID NO: 2968 - protein, 125 aa, Artificial Sequence
  VH3-23_IGHD4-23*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYHRSSYYWYFDSWGQGTLVTVSSAS

SEQ ID NO: 2969 - protein, 126 aa, Artificial Sequence
  VH3-23_IGHD5-5*01(2)_1>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTIAVSTSYYWYFDSWGQGTLVTVSSAS

SEQ ID NO: 2970 - protein, 126 aa, Artificial Sequence
  VH3-23_IGHD5-5*01(2)_1>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNHSCIHSYYWYFDSWGQGTLVTVSSAS

SEQ ID NO: 2971 - protein, 127 aa, Artificial Sequence
  VH3-23_IGHD5-12*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVATISTSYYWYFDSWGQGTLVTVSSAS

SEQ ID NO: 2972 - protein, 127 aa, Artificial Sequence
  VH3-23_IGHD5-12*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNRSHYIHSYYWYFDSWGQGTLVTVSSAS

SEQ ID NO: 2973 - protein, 126 aa, Artificial Sequence; identical to SEQ ID NO: 2969
  VH3-23_IGHD5-18*01(2)_1>1'_IGHJ2*01

SEQ ID NO: 2974 - protein, 126 aa, Artificial Sequence; identical to SEQ ID NO: 2970
  VH3-23_IGHD5-18*01(2)_1>3'_IGHJ2*01

SEQ ID NO: 2975 - protein, 126 aa, Artificial Sequence
  VH3-23_IGHD5-24*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVAISTSYYWYFDSWGQGTLVTVSSAS

SEQ ID NO: 2976 - protein, 126 aa, Artificial Sequence
  VH3-23_IGHD5-24*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNCSHLYSYYWYFDSWGQGTLVTVSSAS

SEQ ID NO: 2977 - protein, 125 aa, Artificial Sequence
  VH3-23_IGHD6-6*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRAAILSYYWYFDSWGQGTLVTVSSAS

SEQ ID NO: 2978 - protein, 125 aa, Artificial Sequence
  VH3-23_IGHD6-6*01>2'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDELLYSSYYWYFDSWGQGTLVTVSSAS

SEQ ID NO: 2979 - protein, 125 aa, Artificial Sequence
  VH3-23_IGHD6-6*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCYTSYYWYFDSWGQGTLVTVSSAS

SEQ ID NO: 2980 - protein, 126 aa, Artificial Sequence
  VH3-23_IGHD6-13*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPAAAIPSYYWYFDSWGQGTLVTVSSAS

SEQ ID NO: 2981 - protein, 126 aa, Artificial Sequence
  VH3-23_IGHD6-13*01>2'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQLLLYPSYYWYFDSWGQGTLVTVSSAS

SEQ ID NO: 2982 - protein, 126 aa, Artificial Sequence
  VH3-23_IGHD6-13*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCCYTSYYWYFDSWGQGTLVTVSSAS

SEQ ID NO: 2983 - protein, 126 aa, Artificial Sequence
  VH3-23_IGHD6-19*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPATAIPSYYWYFDSWGQGTLVTVSSAS

SEQ ID NO: 2984 - protein, 126 aa, Artificial Sequence
  VH3-23_IGHD6-19*01>2'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQPLLYPSYYWYFDSWGQGTLVTVSSAS

SEQ ID NO: 2985 - protein, 126 aa, Artificial Sequence
  VH3-23_IGHD6-19*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSHCYTSYYWYFDSWGQGTLVTVSSAS

SEQ ID NO: 2986 - protein, 125 aa, Artificial Sequence
  VH3-23_IGHD6-25*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVAAAIPSYYWYFDSWGQGTLVTVSSAS

SEQ ID NO: 2987 - protein, 125 aa, Artificial Sequence
  VH3-23_IGHD6-25*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSRCYTSYYWYFDSWGQGTLVTVSSAS

SEQ ID NO: 2988 - protein, 123 aa, Artificial Sequence
  VH3-23_IGHD7-27*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSPVRSYYWYFDSWGQGTLVTVSSAS

SEQ ID NO: 2989 - protein, 123 aa, Artificial Sequence
  VH3-23_IGHD7-27*01>2'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKPQLGSYYWYFDSWGQGTLVTVSSAS

SEQ ID NO: 2990 - protein, 123 aa, Artificial Sequence
  VH3-23_IGHD1-1*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTTGTTSYAFDVWGQGTLVTVSSAS

SEQ ID NO: 2991 - protein, 123 aa, Artificial Sequence
  VH3-23_IGHD1-1*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVQLERRSYAFDVWGQGTLVTVSSAS

SEQ ID NO: 2992 - protein, 123 aa, Artificial Sequence
  VH3-23_IGHD1-1*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNDSYAFDVWGQGTLVTVSSAS

SEQ ID NO: 2993 - protein, 123 aa, Artificial Sequence
  VH3-23_IGHD1-7*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITGTTSYAFDVWGQGTLVTVSSAS

SEQ ID NO: 2994 - protein, 123 aa, Artificial Sequence
  VH3-23_IGHD1-7*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNYSYAFDVWGQGTLVTVSSAS

SEQ ID NO: 2995 - protein, 123 aa, Artificial Sequence; identical to SEQ ID NO: 2993
  VH3-23_IGHD1-14*01>1_IGHJ3*01

SEQ ID NO: 2996 - protein, 123 aa, Artificial Sequence
  VH3-23_IGHD1-14*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNRNHSYAFDVWGQGTLVTVSSAS

SEQ ID NO: 2997 - protein, 123 aa, Artificial Sequence; identical to SEQ ID NO: 2993
  VH3-23_IGHD1-20*01>1_IGHJ3*01

SEQ ID NO: 2998 - protein, 123 aa, Artificial Sequence; identical to SEQ ID NO: 2992
  VH3-23_IGHD1-20*01>3_IGHJ3*01

SEQ ID NO: 2999 - protein, 124 aa, Artificial Sequence
  VH3-23_IGHD1-26*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIVGATTSYAFDVWGQGTLVTVSSAS

SEQ ID NO: 3000 - protein, 124 aa, Artificial Sequence
  VH3-23_IGHD1-26*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSGSYYSYAFDVWGQGTLVTVSSAS

SEQ ID NO: 3001 - protein, 127 aa, Artificial Sequence
  VH3-23_IGHD2-2*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSSTSCYASYAFDVWGQGTLVTVSSAS

SEQ ID NO: 3002 - protein, 127 aa, Artificial Sequence
  VH3-23_IGHD2-2*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVPAAMSYAFDVWGQGTLVTVSSAS

SEQ ID NO: 3003 - protein, 127 aa, Artificial Sequence
  VH3-23_IGHD2-8*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCTNGVCYTSYAFDVWGQGTLVTVSSAS

SEQ ID NO: 3004 - protein, 127 aa, Artificial Sequence
  VH3-23_IGHD2-8*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVLMVYAISYAFDVWGQGTLVTVSSAS

SEQ ID NO: 3005 - protein, 127 aa, Artificial Sequence
  VH3-23_IGHD2-15*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSGGSCYSSYAFDVWGQGTLVTVSSAS

SEQ ID NO: 3006 - protein, 127 aa, Artificial Sequence
  VH3-23_IGHD2-15*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVVAATSYAFDVWGQGTLVTVSSAS

SEQ ID NO: 3007 - protein, 126 aa, Artificial Sequence
  VH3-23_IGHD2-21*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKAYCGGDCYSSYAFDVWGQGTLVTVSSAS

SEQ ID NO: 3008 - protein, 126 aa, Artificial Sequence
  VH3-23_IGHD2-21*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVIAISYAFDVWGQGTLVTVSSAS

SEQ ID NO: 3009 - protein, 127 aa, Artificial Sequence
  VH3-23_IGHD3-3*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVLRFLEWLLYSYAFDVWGQGTLVTVSSAS

SEQ ID NO: 3010 - protein, 127 aa, Artificial Sequence
  VH3-23_IGHD3-3*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDFWSGYYTSYAFDVWGQGTLVTVSSAS

SEQ ID NO: 3011 - protein, 127 aa, Artificial Sequence
  VH3-23_IGHD3-3*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITIFGVVIISYAFDVWGQGTLVTVSSAS

SEQ ID NO: 3012 - protein, 127 aa, Artificial Sequence
  VH3-23_IGHD3-9*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDILTGYYNSYAFDVWGQGTLVTVSSAS

SEQ ID NO: 3013 - protein, 127 aa, Artificial Sequence
  VH3-23_IGHD3-10*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYGSGSYYNSYAFDVWGQGTLVTVSSAS

SEQ ID NO: 3014 - protein, 127 aa, Artificial Sequence
  VH3-23_IGHD3-10*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYAFDVWGQGTLVTVSSAS

SEQ ID NO: 3015 - protein, 129 aa, Artificial Sequence
  VH3-23_IGHD3-16*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDYVWGSYAYTSYAFDVWGQGTLVTVSSAS

SEQ ID NO: 3016 - protein, 129 aa, Artificial Sequence
  VH3-23_IGHD3-16*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIMITFGGVMLISYAFDVWGQGTLVTVSSAS

SEQ ID NO: 3017 - protein, 127 aa, Artificial Sequence
  VH3-23_IGHD3-22*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYDSSGYYYSYAFDVWGQGTLVTVSSAS

SEQ ID NO: 3018 - protein, 127 aa, Artificial Sequence
  VH3-23_IGHD3-22*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMIVVVITSYAFDVWGQGTLVTVSSAS

SEQ ID NO: 3019 - protein, 122 aa, Artificial Sequence
  VH3-23_IGHD4-4*01(1)_1>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYSNYSYAFDVWGQGTLVTVSSAS

SEQ ID NO: 3020 - protein, 122 aa, Artificial Sequence
  VH3-23_IGHD4-4*01(1)_1>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVTSYAFDVWGQGTLVTVSSAS

SEQ ID NO: 3021 - protein, 122 aa, Artificial Sequence; identical to SEQ ID NO: 3019
  VH3-23_IGHD4-11*01(1)_1>2_IGHJ3*01

SEQ ID NO: 3022 - protein, 122 aa, Artificial Sequence; identical to SEQ ID NO: 3020
  VH3-23_IGHD4-11*01(1)_1>3_IGHJ3*01

SEQ ID NO: 3023 - protein, 122 aa, Artificial Sequence
  VH3-23_IGHD4-17*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGDYSYAFDVWGQGTLVTVSSAS

SEQ ID NO: 3024 - protein, 122 aa, Artificial Sequence; identical to SEQ ID NO: 3020
  VH3-23_IGHD4-17*01>3_IGHJ3*01

SEQ ID NO: 3025 - protein, 123 aa, Artificial Sequence
  VH3-23_IGHD4-23*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGGNSSYAFDVWGQGTLVTVSSAS

SEQ ID NO: 3026 - protein, 123 aa, Artificial Sequence
  VH3-23_IGHD4-23*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVVTSYAFDVWGQGTLVTVSSAS

SEQ ID NO: 3027 - protein, 124 aa, Artificial Sequence
  VH3-23_IGHD5-5*01(2)_1>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDTAMVTSYAFDVWGQGTLVTVSSAS

SEQ ID NO: 3028 - protein, 124 aa, Artificial Sequence
  VH3-23_IGHD5-5*01(2)_1>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWIQLWLRSYAFDVWGQGTLVTVSSAS

SEQ ID NO: 3029 - protein, 124 aa, Artificial Sequence
  VH3-23_IGHD5-5*01(2)_1>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSYGYSYAFDVWGQGTLVTVSSAS

SEQ ID NO: 3030 - protein, 125 aa, Artificial Sequence
  VH3-23_IGHD5-12*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDIVATITSYAFDVWGQGTLVTVSSAS

SEQ ID NO: 3031 - protein, 125 aa, Artificial Sequence
  VH3-23_IGHD5-12*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSGYDYSYAFDVWGQGTLVTVSSAS

SEQ ID NO: 3032 - protein, 124 aa, Artificial Sequence; identical to SEQ ID NO: 3027
  VH3-23_IGHD5-18*01(2)_1>1_IGHJ3*01

SEQ ID NO: 3033 - protein, 124 aa, Artificial Sequence; identical to SEQ ID NO: 3028
  VH3-23_IGHD5-18*01(2)_1>2_IGHJ3*01

SEQ ID NO: 3034 - protein, 124 aa, Artificial Sequence; identical to SEQ ID NO: 3029
  VH3-23_IGHD5-18*01(2)_1>3_IGHJ3*01

SEQ ID NO: 3035 - protein, 124 aa, Artificial Sequence
  VH3-23_IGHD5-24*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVEMATITSYAFDVWGQGTLVTVSSAS

SEQ ID NO: 3036 - protein, 124 aa, Artificial Sequence
  VH3-23_IGHD5-24*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRDGYNYSYAFDVWGQGTLVTVSSAS

SEQ ID NO: 3037 - protein, 123 aa, Artificial Sequence
  VH3-23_IGHD6-6*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEYSSSSSYAFDVWGQGTLVTVSSAS

SEQ ID NO: 3038 - protein, 123 aa, Artificial Sequence
  VH3-23_IGHD6-6*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSIAARPSYAFDVWGQGTLVTVSSAS

SEQ ID NO: 3039 - protein, 124 aa, Artificial Sequence
  VH3-23_IGHD6-13*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSSWYSYAFDVWGQGTLVTVSSAS

SEQ ID NO: 3040 - protein, 124 aa, Artificial Sequence
  VH3-23_IGHD6-13*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAAGTSYAFDVWGQGTLVTVSSAS

SEQ ID NO: 3041 - protein, 124 aa, Artificial Sequence
  VH3-23_IGHD6-19*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGWYSYAFDVWGQGTLVTVSSAS

SEQ ID NO: 3042 - protein, 124 aa, Artificial Sequence
  VH3-23_IGHD6-19*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAVAGTSYAFDVWGQGTLVTVSSAS

SEQ ID NO: 3043 - protein, 123 aa, Artificial Sequence
  VH3-23_IGHD6-25*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGYSYAFDVWGQGTLVTVSSAS

SEQ ID NO: 3044 - protein, 123 aa, Artificial Sequence
  VH3-23_IGHD6-25*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAATSYAFDVWGQGTLVTVSSAS

SEQ ID NO: 3045 - protein, 121 aa, Artificial Sequence
  VH3-23_IGHD7-27*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKLTGESYAFDVWGQGTLVTVSSAS

SEQ ID NO: 3046 - protein, 121 aa, Artificial Sequence
  VH3-23_IGHD7-27*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKANWGSYAFDVWGQGTLVTVSSAS

SEQ ID NO: 3047 - protein, 123 aa, Artificial Sequence
  VH3-23_IGHD1-1*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVVPSYAFDVWGQGTLVTVSSAS

SEQ ID NO: 3048 - protein, 123 aa, Artificial Sequence
  VH3-23_IGHD1-1*01>2'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSFQLYRSYAFDVWGQGTLVTVSSAS

SEQ ID NO: 3049 - protein, 123 aa, Artificial Sequence
  VH3-23_IGHD1-1*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSCTSYAFDVWGQGTLVTVSSAS

SEQ ID NO: 3050 - protein, 123 aa, Artificial Sequence
  VH3-23_IGHD1-7*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVIPSYAFDVWGQGTLVTVSSAS

SEQ ID NO: 3051 - protein, 123 aa, Artificial Sequence
  VH3-23_IGHD1-7*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYTSYAFDVWGQGTLVTVSSAS

SEQ ID NO: 3052 - protein, 123 aa, Artificial Sequence; identical to SEQ ID NO: 3050
  VH3-23_IGHD1-14*01>1'_IGHJ3*01

SEQ ID NO: 3053 - protein, 123 aa, Artificial Sequence
  VH3-23_IGHD1-14*01>2'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWFRLYRSYAFDVWGQGTLVTVSSAS

SEQ ID NO: 3054 - protein, 123 aa, Artificial Sequence
  VH3-23_IGHD1-14*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGSGYTSYAFDVWGQGTLVTVSSAS

SEQ ID NO: 3055 - protein, 123 aa, Artificial Sequence; identical to SEQ ID NO: 3050
  VH3-23_IGHD1-20*01>1'_IGHJ3*01

SEQ ID NO: 3056 - protein, 123 aa, Artificial Sequence; identical to SEQ ID NO: 3048
  VH3-23_IGHD1-20*01>2'_IGHJ3*01

SEQ ID NO: 3057 - protein, 123 aa, Artificial Sequence
  VH3-23_IGHD1-20*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSYTSYAFDVWGQGTLVTVSSAS

SEQ ID NO: 3058 - protein, 124 aa, Artificial Sequence
  VH3-23_IGHD1-26*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVAPTIPSYAFDVWGQGTLVTVSSAS

SEQ ID NO: 3059 - protein, 124 aa, Artificial Sequence
  VH3-23_IGHD1-26*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSHYTSYAFDVWGQGTLVTVSSAS

SEQ ID NO: 3060 - protein, 127 aa, Artificial Sequence
  VH3-23_IGHD2-2*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAGTTTISSYAFDVWGQGTLVTVSSAS

SEQ ID NO: 3061 - protein, 127 aa, Artificial Sequence
  VH3-23_IGHD2-2*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGHSSWYYYNISYAFDVWGQGTLVTVSSAS

SEQ ID NO: 3062 - protein, 127 aa, Artificial Sequence
  VH3-23_IGHD2-8*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAYTISTISSYAFDVWGQGTLVTVSSAS

SEQ ID NO: 3063 - protein, 127 aa, Artificial Sequence
  VH3-23_IGHD2-15*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVAATTTTISSYAFDVWGQGTLVTVSSAS

SEQ ID NO: 3064 - protein, 127 aa, Artificial Sequence
  VH3-23_IGHD2-15*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYHHYNISYAFDVWGQGTLVTVSSAS

SEQ ID NO: 3065 - protein, 126 aa, Artificial Sequence
  VH3-23_IGHD2-21*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAITTTICSYAFDVWGQGTLVTVSSAS

SEQ ID NO: 3066 - protein, 126 aa, Artificial Sequence
  VH3-23_IGHD2-21*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNSNHHHNMSYAFDVWGQGTLVTVSSAS

SEQ ID NO: 3067 - protein, 127 aa, Artificial Sequence
  VH3-23_IGHD3-3*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIITTPKIVISYAFDVWGQGTLVTVSSAS

SEQ ID NO: 3068 - protein, 127 aa, Artificial Sequence
  VH3-23_IGHD3-3*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNHSKNRNSYAFDVWGQGTLVTVSSAS

SEQ ID NO: 3069 - protein, 127 aa, Artificial Sequence
  VH3-23_IGHD3-9*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITSQNIVISYAFDVWGQGTLVTVSSAS

SEQ ID NO: 3070 - protein, 127 aa, Artificial Sequence
  B12_VH3-23_IGHD3-9*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNQSKYRNSYAFDVWGQGTLVTVSSAS

SEQ ID NO: 3071 - protein, 127 aa, Artificial Sequence
  VH3-23_IGHD3-10*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITPRTIVISYAFDVWGQGTLVTVSSAS

SEQ ID NO: 3072 - protein, 127 aa, Artificial Sequence
  VH3-23_IGHD3-10*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNSPNHSNSYAFDVWGQGTLVTVSSAS

SEQ ID NO: 3073 - protein, 129 aa, Artificial Sequence
  VH3-23_IGHD3-16*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGISITPPNVIIISYAFDVWGQGTLVTVSSAS

SEQ ID NO: 3074 - protein, 129 aa, Artificial Sequence
  VH3-23_IGHD3-16*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYKHNSPKRNHNSYAFDVWGQGTLVTVSSAS

SEQ ID NO: 3075 - protein, 127 aa, Artificial Sequence
  VH3-23_IGHD3-22*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVITTTIIVISYAFDVWGQGTLVTVSSAS

SEQ ID NO: 3076 - protein, 122 aa, Artificial Sequence
  VH3-23_IGHD4-4*01(1)_1>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVTVVSYAFDVWGQGTLVTVSSAS

SEQ ID NO: 3077 - protein, 122 aa, Artificial Sequence
  VH3-23_IGHD4-4*01(1)_1>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYCSSYAFDVWGQGTLVTVSSAS

SEQ ID NO: 3078 - protein, 122 aa, Artificial Sequence; identical to SEQ ID NO: 3076
  VH3-23_IGHD4-11*01(1)_1>1'_IGHJ3*01

SEQ ID NO: 3079 - protein, 122 aa, Artificial Sequence; identical to SEQ ID NO: 3077
  VH3-23_IGHD4-11*01(1)_1>3'_IGHJ3*01

SEQ ID NO: 3080 - protein, 122 aa, Artificial Sequence; identical to SEQ ID NO: 3076
  VH3-23_IGHD4-17*01>1'_IGHJ3*01

SEQ ID NO: 3081 - protein, 122 aa, Artificial Sequence
  VH3-23_IGHD4-17*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSHRSSYAFDVWGQGTLVTVSSAS

SEQ ID NO: 3082 - protein, 123 aa, Artificial Sequence
  VH3-23_IGHD4-23*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVTTVVSYAFDVWGQGTLVTVSSAS

SEQ ID NO: 3083 - protein, 123 aa, Artificial Sequence
  VH3-23_IGHD4-23*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYHRSSYAFDVWGQGTLVTVSSAS

SEQ ID NO: 3084 - protein, 124 aa, Artificial Sequence
  VH3-23_IGHD5-5*01(2)_1>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTIAVSTSYAFDVWGQGTLVTVSSAS

SEQ ID NO: 3085 - protein, 124 aa, Artificial Sequence
  VH3-23_IGHD5-5*01(2)_1>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNHSCIHSYAFDVWGQGTLVTVSSAS

SEQ ID NO: 3086 - protein, 125 aa, Artificial Sequence
  VH3-23_IGHD5-12*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVATISTSYAFDVWGQGTLVTVSSAS

SEQ ID NO: 3087 - protein, 125 aa, Artificial Sequence
  VH3-23_IGHD5-12*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNRSHYIHSYAFDVWGQGTLVTVSSAS

SEQ ID NO: 3088 - protein, 124 aa, Artificial Sequence; identical to SEQ ID NO: 3084
  VH3-23_IGHD5-18*01(2)_1>1'_IGHJ3*01

SEQ ID NO: 3089 - protein, 124 aa, Artificial Sequence; identical to SEQ ID NO: 3085
  VH3-23_IGHD5-18*01(2)_1>3'_IGHJ3*

SEQ ID NO: 3090 - protein, 124 aa, Artificial Sequence
  VH3-23_IGHD5-24*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVAISTSYAFDVWGQGTLVTVSSAS

SEQ ID NO: 3091 - protein, 124 aa, Artificial Sequence
  VH3-23_IGHD5-24*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNCSHLYSYAFDVWGQGTLVTVSSAS

SEQ ID NO: 3092 - protein, 123 aa, Artificial Sequence
  VH3-23_IGHD6-6*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRAAILSYAFDVWGQGTLVTVSSAS

SEQ ID NO: 3093 - protein, 123 aa, Artificial Sequence
  VH3-23_IGHD6-6*01>2'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDELLYSSYAFDVWGQGTLVTVSSAS

SEQ ID NO: 3094 - protein, 123 aa, Artificial Sequence
  VH3-23_IGHD6-6*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCYTSYAFDVWGQGTLVTVSSAS

SEQ ID NO: 3095 - protein, 124 aa, Artificial Sequence
  VH3-23_IGHD6-13*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPAAAIPSYAFDVWGQGTLVTVSSAS

SEQ ID NO: 3096 - protein, 124 aa, Artificial Sequence
  VH3-23_IGHD6-13*01>2'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQLLLYPSYAFDVWGQGTLVTVSSAS

SEQ ID NO: 3097 - protein, 124 aa, Artificial Sequence
  VH3-23_IGHD6-13*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCCYTSYAFDVWGQGTLVTVSSAS

SEQ ID NO: 3098 - protein, 124 aa, Artificial Sequence
  VH3-23_IGHD6-19*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPATAIPSYAFDVWGQGTLVTVSSAS

SEQ ID NO: 3099 - protein, 124 aa, Artificial Sequence
  VH3-23_IGHD6-19*01>2'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQPLLYPSYAFDVWGQGTLVTVSSAS

SEQ ID NO: 3100 - protein, 124 aa, Artificial Sequence
  VH3-23_IGHD6-19*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSHCYTSYAFDVWGQGTLVTVSSAS

SEQ ID NO: 3101 - protein, 123 aa, Artificial Sequence
  VH3-23_IGHD6-25*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVAAAIPSYAFDVWGQGTLVTVSSAS

SEQ ID NO: 3102 - protein, 123 aa, Artificial Sequence
  VH3-23_IGHD6-25*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSRCYTSYAFDVWGQGTLVTVSSAS

SEQ ID NO: 3103 - protein, 121 aa, Artificial Sequence
  VH3-23_IGHD7-27*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSPVRSYAFDVWGQGTLVTVSSAS

SEQ ID NO: 3104 - protein, 121 aa, Artificial Sequence
  VH3-23_IGHD7-27*01>2'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKPQLGSYAFDVWGQGTLVTVSSAS

SEQ ID NO: 3105 - protein, 123 aa, Artificial Sequence
  VH3-23_IGHD1-1*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTTGTTSYYFDYWGQGTLVTVSSAS

SEQ ID NO: 3106 - protein, 123 aa, Artificial Sequence
  VH3-23_IGHD1-1*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVQLERRSYYFDYWGQGTLVTVSSAS

SEQ ID NO: 3107 - protein, 123 aa, Artificial Sequence
  VH3-23_IGHD1-1*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNDSYYFDYWGQGTLVTVSSAS

SEQ ID NO: 3108 - protein, 123 aa, Artificial Sequence
  VH3-23_IGHD1-7*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITGTTSYYFDYWGQGTLVTVSSAS

SEQ ID NO: 3109 - protein, 123 aa, Artificial Sequence
  VH3-23_IGHD1-7*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNYSYYFDYWGQGTLVTVSSAS

SEQ ID NO: 3110 - protein, 123 aa, Artificial Sequence; identical to SEQ ID NO: 3108
  VH3-23_IGHD1-14*01>1_IGHJ4*01

SEQ ID NO: 3111 - protein, 123 aa, Artificial Sequence
  VH3-23_IGHD1-14*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNRNHSYYFDYWGQGTLVTVSSAS

SEQ ID NO: 3112 - protein, 123 aa, Artificial Sequence; identical to SEQ ID NO: 3108
  VH3-23_IGHD1-20*01>1_IGHJ4*01

SEQ ID NO: 3113 - protein, 123 aa, Artificial Sequence; identical to SEQ ID NO: 3107
  VH3-23_IGHD1-20*01>3_IGHJ4*01

SEQ ID NO: 3114 - protein, 124 aa, Artificial Sequence
  VH3-23_IGHD1-26*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIVGATTSYYFDYWGQGTLVTVSSAS

SEQ ID NO: 3115 - protein, 124 aa, Artificial Sequence
  VH3-23_IGHD1-26*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSGSYYSYYFDYWGQGTLVTVSSAS

SEQ ID NO: 3116 - protein, 127 aa, Artificial Sequence
  VH3-23_IGHD2-2*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSSTSCYASYYFDYWGQGTLVTVSSAS

SEQ ID NO: 3117 - protein, 127 aa, Artificial Sequence
  VH3-23_IGHD2-2*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVPAAMSYYFDYWGQGTLVTVSSAS

SEQ ID NO: 3118 - protein, 127 aa, Artificial Sequence
  VH3-23_IGHD2-8*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCTNGVCYTSYYFDYWGQGTLVTVSSAS

SEQ ID NO: 3119 - protein, 127 aa, Artificial Sequence
  VH3-23_IGHD2-8*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVLMVYAISYYFDYWGQGTLVTVSSAS

SEQ ID NO: 3120 - protein, 127 aa, Artificial Sequence
  VH3-23_IGHD2-15*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSGGSCYSSYYFDYWGQGTLVTVSSAS

SEQ ID NO: 3121 - protein, 127 aa, Artificial Sequence
  VH3-23_IGHD2-15*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVVAATSYYFDYWGQGTLVTVSSAS

SEQ ID NO: 3122 - protein, 126 aa, Artificial Sequence
  VH3-23_IGHD2-21*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKAYCGGDCYSSYYFDYWGQGTLVTVSSAS

SEQ ID NO: 3123 - protein, 126 aa, Artificial Sequence
  VH3-23_IGHD2-21*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVIAISYYFDYWGQGTLVTVSSAS

SEQ ID NO: 3124 - protein, 127 aa, Artificial Sequence
  VH3-23_IGHD3-3*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVLRFLEWLLYSYYFDYWGQGTLVTVSSAS

SEQ ID NO: 3125 - protein, 127 aa, Artificial Sequence
  VH3-23_IGHD3-3*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDFWSGYYTSYYFDYWGQGTLVTVSSAS

SEQ ID NO: 3126 - protein, 127 aa, Artificial Sequence
  VH3-23_IGHD3-3*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITIFGVVIISYYFDYWGQGTLVTVSSAS

SEQ ID NO: 3127 - protein, 127 aa, Artificial Sequence
  VH3-23_IGHD3-9*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDILTGYYNSYYFDYWGQGTLVTVSSAS

SEQ ID NO: 3128 - protein, 127 aa, Artificial Sequence
  VH3-23_IGHD3-10*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYGSGSYYNSYYFDYWGQGTLVTVSSAS

SEQ ID NO: 3129 - protein, 127 aa, Artificial Sequence
  VH3-23_IGHD3-10*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYFDYWGQGTLVTVSSAS

SEQ ID NO: 3130 - protein, 129 aa, Artificial Sequence
  VH3-23_IGHD3-16*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDYVWGSYAYTSYYFDYWGQGTLVTVSSAS

SEQ ID NO: 3131 - protein, 129 aa, Artificial Sequence
  _VH3-23_IGHD3-16*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIMITFGGVMLISYYFDYWGQGTLVTVSSAS

SEQ ID NO: 3132 - protein, 127 aa, Artificial Sequence
  VH3-23_IGHD3-22*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYDSSGYYYSYYFDYWGQGTLVTVSSAS

SEQ ID NO: 3133 - protein, 127 aa, Artificial Sequence
  VH3-23_IGHD3-22*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMIVVVITSYYFDYWGQGTLVTVSSAS

SEQ ID NO: 3134 - protein, 122 aa, Artificial Sequence
  VH3-23_IGHD4-4*01(1)_1>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYSNYSYYFDYWGQGTLVTVSSAS

SEQ ID NO: 3135 - protein, 122 aa, Artificial Sequence
  VH3-23_IGHD4-4*01(1)_1>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVTSYYFDYWGQGTLVTVSSAS

SEQ ID NO: 3136 - protein, 122 aa, Artificial Sequence; identical to SEQ ID NO: 3134
  VH3-23_IGHD4-11*01(1)_1>2_IGHJ4*01

SEQ ID NO: 3137 - protein, 122 aa, Artificial Sequence; identical to SEQ ID NO: 3135
  VH3-23_IGHD4-11*01(1)_1>3_IGHJ4*01

SEQ ID NO: 3138 - protein, 122 aa, Artificial Sequence
  VH3-23_IGHD4-17*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGDYSYYFDYWGQGTLVTVSSAS

SEQ ID NO: 3139 - protein, 122 aa, Artificial Sequence; identical to SEQ ID NO: 3135
  VH3-23_IGHD4-17*01>3_IGHJ4*01

SEQ ID NO: 3140 - protein, 123 aa, Artificial Sequence
  VH3-23_IGHD4-23*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGGNSSYYFDYWGQGTLVTVSSAS

SEQ ID NO: 3141 - protein, 123 aa, Artificial Sequence
  VH3-23_IGHD4-23*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVVTSYYFDYWGQGTLVTVSSAS

SEQ ID NO: 3142 - protein, 124 aa, Artificial Sequence
  VH3-23_IGHD5-5*01(2)_1>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDTAMVTSYYFDYWGQGTLVTVSSAS

SEQ ID NO: 3143 - protein, 124 aa, Artificial Sequence
  VH3-23_IGHD5-5*01(2)_1>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWIQLWLRSYYFDYWGQGTLVTVSSAS

SEQ ID NO: 3144 - protein, 124 aa, Artificial Sequence
  VH3-23_IGHD5-5*01(2)_1>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSYGYSYYFDYWGQGTLVTVSSAS

SEQ ID NO: 3145 - protein, 125 aa, Artificial Sequence
  VH3-23_IGHD5-12*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDIVATITSYYFDYWGQGTLVTVSSAS

SEQ ID NO: 3146 - protein, 125 aa, Artificial Sequence
  VH3-23_IGHD5-12*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSGYDYSYYFDYWGQGTLVTVSSAS

SEQ ID NO: 3147 - protein, 124 aa, Artificial Sequence; identical to SEQ ID NO: 3142
  VH3-23_IGHD5-18*01(2)_1>1_IGHJ4*01

SEQ ID NO: 3148 - protein, 124 aa, Artificial Sequence; identical to SEQ ID NO: 3143
  VH3-23_IGHD5-18*01(2)_1>2_IGHJ4*01

SEQ ID NO: 3149 - protein, 124 aa, Artificial Sequence; identical to SEQ ID NO: 3144
  VH3-23_IGHD5-18*01(2)_1>3_IGHJ4*01

SEQ ID NO: 3150 - protein, 124 aa, Artificial Sequence
  VH3-23_IGHD5-24*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVEMATITSYYFDYWGQGTLVTVSSAS

SEQ ID NO: 3151 - protein, 124 aa, Artificial Sequence
  VH3-23_IGHD5-24*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRDGYNYSYYFDYWGQGTLVTVSSAS

SEQ ID NO: 3152 - protein, 123 aa, Artificial Sequence
  VH3-23_IGHD6-6*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEYSSSSSYYFDYWGQGTLVTVSSAS

SEQ ID NO: 3153 - protein, 123 aa, Artificial Sequence
  VH3-23_IGHD6-6*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSIAARPSYYFDYWGQGTLVTVSSAS

SEQ ID NO: 3154 - protein, 124 aa, Artificial Sequence
  VH3-23_IGHD6-13*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSSWYSYYFDYWGQGTLVTVSSAS

SEQ ID NO: 3155 - protein, 124 aa, Artificial Sequence
  VH3-23_IGHD6-13*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAAGTSYYFDYWGQGTLVTVSSAS

SEQ ID NO: 3156 - protein, 124 aa, Artificial Sequence
  VH3-23_IGHD6-19*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGWYSYYFDYWGQGTLVTVSSAS

SEQ ID NO: 3157 - protein, 124 aa, Artificial Sequence
  VH3-23_IGHD6-19*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAVAGTSYYFDYWGQGTLVTVSSAS

SEQ ID NO: 3158 - protein, 123 aa, Artificial Sequence
  VH3-23_IGHD6-25*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGYSYYFDYWGQGTLVTVSSAS

SEQ ID NO: 3159 - protein, 123 aa, Artificial Sequence
  VH3-23_IGHD6-25*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAATSYYFDYWGQGTLVTVSSAS

SEQ ID NO: 3160 - protein, 121 aa, Artificial Sequence
  VH3-23_IGHD7-27*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKLTGESYYFDYWGQGTLVTVSSAS

SEQ ID NO: 3161 - protein, 121 aa, Artificial Sequence
  VH3-23_IGHD7-27*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKANWGSYYFDYWGQGTLVTVSSAS

SEQ ID NO: 3162 - protein, 123 aa, Artificial Sequence
  VH3-23_IGHD1-1*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVVPSYYFDYWGQGTLVTVSSAS

SEQ ID NO: 3163 - protein, 123 aa, Artificial Sequence
  VH3-23_IGHD1-1*01>2'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSFQLYRSYYFDYWGQGTLVTVSSAS

SEQ ID NO: 3164 - protein, 123 aa, Artificial Sequence
  VH3-23_IGHD1-1*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSCTSYYFDYWGQGTLVTVSSAS

SEQ ID NO: 3165 - protein, 123 aa, Artificial Sequence
  VH3-23_IGHD1-7*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVIPSYYFDYWGQGTLVTVSSAS

SEQ ID NO: 3166 - protein, 123 aa, Artificial Sequence
  VH3-23_IGHD1-7*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYTSYYFDYWGQGTLVTVSSAS

SEQ ID NO: 3167 - protein, 123 aa, Artificial Sequence; identical to SEQ ID NO: 3165
  VH3-23_IGHD1-14*01>1'_IGHJ4*01

SEQ ID NO: 3168 - protein, 123 aa, Artificial Sequence
  VH3-23_IGHD1-14*01>2'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWFRLYRSYYFDYWGQGTLVTVSSAS

SEQ ID NO: 3169 - protein, 123 aa, Artificial Sequence
  VH3-23_IGHD1-14*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGSGYTSYYFDYWGQGTLVTVSSAS

SEQ ID NO: 3170 - protein, 123 aa, Artificial Sequence; identical to SEQ ID NO: 3165
  VH3-23_IGHD1-20*01>1'_IGHJ4*01

SEQ ID NO: 3171 - protein, 123 aa, Artificial Sequence; identical to SEQ ID NO: 3163
  VH3-23_IGHD1-20*01>2'_IGHJ4*01

SEQ ID NO: 3172 - protein, 123 aa, Artificial Sequence
  VH3-23_IGHD1-20*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSYTSYYFDYWGQGTLVTVSSAS

SEQ ID NO: 3173 - protein, 124 aa, Artificial Sequence
  VH3-23_IGHD1-26*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVAPTIPSYYFDYWGQGTLVTVSSAS

SEQ ID NO: 3174 - protein, 124 aa, Artificial Sequence
  VH3-23_IGHD1-26*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSHYTSYYFDYWGQGTLVTVSSAS

SEQ ID NO: 3175 - protein, 127 aa, Artificial Sequence
  VH3-23_IGHD2-2*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAGTTTISSYYFDYWGQGTLVTVSSAS

SEQ ID NO: 3176 - protein, 127 aa, Artificial Sequence
  VH3-23_IGHD2-2*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGHSSWYYYNISYYFDYWGQGTLVTVSSAS

SEQ ID NO: 3177 - protein, 127 aa, Artificial Sequence
  VH3-23_IGHD2-8*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAYTISTISSYYFDYWGQGTLVTVSSAS

SEQ ID NO: 3178 - protein, 127 aa, Artificial Sequence
  VH3-23_IGHD2-15*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVAATTTTISSYYFDYWGQGTLVTVSSAS

SEQ ID NO: 3179 - protein, 127 aa, Artificial Sequence
  VH3-23_IGHD2-15*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYHHYNISYYFDYWGQGTLVTVSSAS

SEQ ID NO: 3180 - protein, 126 aa, Artificial Sequence
  VH3-23_IGHD2-21*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAITTTICSYYFDYWGQGTLVTVSSAS

SEQ ID NO: 3181 - protein, 126 aa, Artificial Sequence
  VH3-23_IGHD2-21*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNSNHHHNMSYYFDYWGQGTLVTVSSAS

SEQ ID NO: 3182 - protein, 127 aa, Artificial Sequence
  VH3-23_IGHD3-3*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIITTPKIVISYYFDYWGQGTLVTVSSAS

SEQ ID NO: 3183 - protein, 127 aa, Artificial Sequence
  VH3-23_IGHD3-3*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNHSKNRNSYYFDYWGQGTLVTVSSAS

SEQ ID NO: 3184 - protein, 127 aa, Artificial Sequence
  VH3-23_IGHD3-9*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITSQNIVISYYFDYWGQGTLVTVSSAS

SEQ ID NO: 3185 - protein, 127 aa, Artificial Sequence
  VH3-23_IGHD3-9*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNQSKYRNSYYFDYWGQGTLVTVSSAS

SEQ ID NO: 3186 - protein, 127 aa, Artificial Sequence
  VH3-23_IGHD3-10*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITPRTIVISYYFDYWGQGTLVTVSSAS

SEQ ID NO: 3187 - protein, 127 aa, Artificial Sequence
  VH3-23_IGHD3-10*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNSPNHSNSYYFDYWGQGTLVTVSSAS

SEQ ID NO: 3188 - protein, 129 aa, Artificial Sequence
  VH3-23_IGHD3-16*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGISITPPNVIIISYYFDYWGQGTLVTVSSAS

SEQ ID NO: 3189 - protein, 129 aa, Artificial Sequence
  VH3-23_IGHD3-16*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYKHNSPKRNHNSYYFDYWGQGTLVTVSSAS

SEQ ID NO: 3190 - protein, 127 aa, Artificial Sequence
  VH3-23_IGHD3-22*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVITTTIIVISYYFDYWGQGTLVTVSSAS

SEQ ID NO: 3191 - protein, 122 aa, Artificial Sequence
  VH3-23_IGHD4-4*01(1)_1>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVTVVSYYFDYWGQGTLVTVSSAS

SEQ ID NO: 3192 - protein, 122 aa, Artificial Sequence
  VH3-23_IGHD4-4*01(1)_1>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYCSSYYFDYWGQGTLVTVSSAS

SEQ ID NO: 3193 - protein, 122 aa, Artificial Sequence; identical to SEQ ID NO: 3191
  VH3-23_IGHD4-11*01(1)_1>1'_IGHJ4*01

SEQ ID NO: 3194 - protein, 122 aa, Artificial Sequence; identical to SEQ ID NO: 3192
  VH3-23_IGHD4-11*01(1)_1>3'_IGHJ4*01

SEQ ID NO: 3195 - protein, 122 aa, Artificial Sequence; identical to SEQ ID NO: 3191
  VH3-23_IGHD4-17*01>1'_IGHJ4*01

SEQ ID NO: 3196 - protein, 122 aa, Artificial Sequence
  VH3-23_IGHD4-17*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSHRSSYYFDYWGQGTLVTVSSAS

SEQ ID NO: 3197 - protein, 123 aa, Artificial Sequence
  VH3-23_IGHD4-23*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVTTVVSYYFDYWGQGTLVTVSSAS

SEQ ID NO: 3198 - protein, 123 aa, Artificial Sequence
  VH3-23_IGHD4-23*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYHRSSYYFDYWGQGTLVTVSSAS

SEQ ID NO: 3199 - protein, 124 aa, Artificial Sequence
  VH3-23_IGHD5-5*01(2)_1>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTIAVSTSYYFDYWGQGTLVTVSSAS

SEQ ID NO: 3200 - protein, 124 aa, Artificial Sequence
  VH3-23_IGHD5-5*01(2)_1>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNHSCIHSYYFDYWGQGTLVTVSSAS

SEQ ID NO: 3201 - protein, 125 aa, Artificial Sequence
  VH3-23_IGHD5-12*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVATISTSYYFDYWGQGTLVTVSSAS

SEQ ID NO: 3202 - protein, 125 aa, Artificial Sequence
  VH3-23_IGHD5-12*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNRSHYIHSYYFDYWGQGTLVTVSSAS

SEQ ID NO: 3203 - protein, 124 aa, Artificial Sequence; identical to SEQ ID NO: 3199
  VH3-23_IGHD5-18*01(2)_1>1'_IGHJ4*01

SEQ ID NO: 3204 - protein, 124 aa, Artificial Sequence; identical to SEQ ID NO: 3200
  VH3-23_IGHD5-18*01(2)_1>3'_IGHJ4*01

SEQ ID NO: 3205 - protein, 124 aa, Artificial Sequence
  VH3-23_IGHD5-24*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVAISTSYYFDYWGQGTLVTVSSAS

SEQ ID NO: 3206 - protein, 124 aa, Artificial Sequence
  VH3-23_IGHD5-24*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNCSHLYSYYFDYWGQGTLVTVSSAS

SEQ ID NO: 3207 - protein, 123 aa, Artificial Sequence
  VH3-23_IGHD6-6*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRAAILSYYFDYWGQGTLVTVSSAS

SEQ ID NO: 3208 - protein, 123 aa, Artificial Sequence
  VH3-23_IGHD6-6*01>2'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDELLYSSYYFDYWGQGTLVTVSSAS

SEQ ID NO: 3209 - protein, 123 aa, Artificial Sequence
  VH3-23_IGHD6-6*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCYTSYYFDYWGQGTLVTVSSAS

SEQ ID NO: 3210 - protein, 124 aa, Artificial Sequence
  VH3-23_IGHD6-13*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPAAAIPSYYFDYWGQGTLVTVSSAS

SEQ ID NO: 3211 - protein, 124 aa, Artificial Sequence
  VH3-23_IGHD6-13*01>2'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQLLLYPSYYFDYWGQGTLVTVSSAS

SEQ ID NO: 3212 - protein, 124 aa, Artificial Sequence
  VH3-23_IGHD6-13*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCCYTSYYFDYWGQGTLVTVSSAS

SEQ ID NO: 3213 - protein, 124 aa, Artificial Sequence
  VH3-23_IGHD6-19*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPATAIPSYYFDYWGQGTLVTVSSAS

SEQ ID NO: 3214 - protein, 124 aa, Artificial Sequence
  VH3-23_IGHD6-19*01>2'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQPLLYPSYYFDYWGQGTLVTVSSAS

SEQ ID NO: 3215 - protein, 124 aa, Artificial Sequence
  VH3-23_IGHD6-19*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSHCYTSYYFDYWGQGTLVTVSSAS

SEQ ID NO: 3216 - protein, 123 aa, Artificial Sequence
  VH3-23_IGHD6-25*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVAAAIPSYYFDYWGQGTLVTVSSAS

SEQ ID NO: 3217 - protein, 123 aa, Artificial Sequence
  VH3-23_IGHD6-25*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSRCYTSYYFDYWGQGTLVTVSSAS

SEQ ID NO: 3218 - protein, 121 aa, Artificial Sequence
  VH3-23_IGHD7-27*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSPVRSYYFDYWGQGTLVTVSSAS

SEQ ID NO: 3219 - protein, 121 aa, Artificial Sequence
  VH3-23_IGHD7-27*01>2'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKPQLGSYYFDYWGQGTLVTVSSAS

SEQ ID NO: 3220 - protein, 124 aa, Artificial Sequence
  VH3-23_IGHD1-1*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTTGTTSYNWFDYWGQGTLVTVSSAS

SEQ ID NO: 3221 - protein, 124 aa, Artificial Sequence
  VH3-23_IGHD1-1*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVQLERRSYNWFDYWGQGTLVTVSSAS

SEQ ID NO: 3222 - protein, 124 aa, Artificial Sequence
  VH3-23_IGHD1-1*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNDSYNWFDYWGQGTLVTVSSAS

SEQ ID NO: 3223 - protein, 124 aa, Artificial Sequence
  VH3-23_IGHD1-7*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITGTTSYNWFDYWGQGTLVTVSSAS

SEQ ID NO: 3224 - protein, 124 aa, Artificial Sequence
  VH3-23_IGHD1-7*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNYSYNWFDYWGQGTLVTVSSAS

SEQ ID NO: 3225 - protein, 124 aa, Artificial Sequence; identical to SEQ ID NO: 3223
  VH3-23_IGHD1-14*01>1_IGHJ5*01

SEQ ID NO: 3226 - protein, 124 aa, Artificial Sequence
  VH3-23_IGHD1-14*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNRNHSYNWFDYWGQGTLVTVSSAS

SEQ ID NO: 3227 - protein, 124 aa, Artificial Sequence; identical to SEQ ID NO: 3223
  VH3-23_IGHD1-20*01>1_IGHJ5*01

SEQ ID NO: 3228 - protein, 124 aa, Artificial Sequence; identical to SEQ ID NO: 3222
  VH3-23_IGHD1-20*01>3_IGHJ5*01

SEQ ID NO: 3229 - protein, 125 aa, Artificial Sequence
  VH3-23_IGHD1-26*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIVGATTSYNWFDYWGQGTLVTVSSAS

SEQ ID NO: 3230 - protein, 125 aa, Artificial Sequence
  VH3-23_IGHD1-26*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSGSYYSYNWFDYWGQGTLVTVSSAS

SEQ ID NO: 3231 - protein, 128 aa, Artificial Sequence
  VH3-23_IGHD2-2*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSSTSCYASYNWFDYWGQGTLVTVSSAS

SEQ ID NO: 3232 - protein, 128 aa, Artificial Sequence
  VH3-23_IGHD2-2*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVPAAMSYNWFDYWGQGTLVTVSSAS

SEQ ID NO: 3233 - protein, 128 aa, Artificial Sequence
  VH3-23_IGHD2-8*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCTNGVCYTSYNWFDYWGQGTLVTVSSAS

SEQ ID NO: 3234 - protein, 128 aa, Artificial Sequence
  VH3-23_IGHD2-8*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVLMVYAISYNWFDYWGQGTLVTVSSAS

SEQ ID NO: 3235 - protein, 128 aa, Artificial Sequence
  VH3-23_IGHD2-15*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSGGSCYSSYNWFDYWGQGTLVTVSSAS

SEQ ID NO: 3236 - protein, 128 aa, Artificial Sequence
  VH3-23_IGHD2-15*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVVAATSYNWFDYWGQGTLVTVSSAS

SEQ ID NO: 3237 - protein, 127 aa, Artificial Sequence
  VH3-23_IGHD2-21*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKAYCGGDCYSSYNWFDYWGQGTLVTVSSAS

SEQ ID NO: 3238 - protein, 127 aa, Artificial Sequence
  VH3-23_IGHD2-21*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVIAISYNWFDYWGQGTLVTVSSAS

SEQ ID NO: 3239 - protein, 128 aa, Artificial Sequence
  VH3-23_IGHD3-3*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVLRFLEWLLYSYNWFDYWGQGTLVTVSSAS

SEQ ID NO: 3240 - protein, 128 aa, Artificial Sequence
  VH3-23_IGHD3-3*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDFWSGYYTSYNWFDYWGQGTLVTVSSAS

SEQ ID NO: 3241 - protein, 128 aa, Artificial Sequence
  VH3-23_IGHD3-3*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITIFGVVIISYNWFDYWGQGTLVTVSSAS

SEQ ID NO: 3242 - protein, 128 aa, Artificial Sequence
  VH3-23_IGHD3-9*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDILTGYYNSYNWFDYWGQGTLVTVSSAS

SEQ ID NO: 3243 - protein, 128 aa, Artificial Sequence
  VH3-23_IGHD3-10*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYGSGSYYNSYNWFDYWGQGTLVTVSSAS

SEQ ID NO: 3244 - protein, 128 aa, Artificial Sequence
  VH3-23_IGHD3-10*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYNWFDYWGQGTLVTVSSAS

SEQ ID NO: 3245 - protein, 130 aa, Artificial Sequence
  VH3-23_IGHD3-16*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDYVWGSYAYTSYNWFDYWGQGTLVTVSSAS

SEQ ID NO: 3246 - protein, 130 aa, Artificial Sequence
  VH3-23_IGHD3-16*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIMITFGGVMLISYNWFDYWGQGTLVTVSSAS

SEQ ID NO: 3247 - protein, 128 aa, Artificial Sequence
  VH3-23_IGHD3-22*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYDSSGYYYSYNWFDYWGQGTLVTVSSAS

SEQ ID NO: 3248 - protein, 128 aa, Artificial Sequence
  VH3-23_IGHD3-22*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMIVVVITSYNWFDYWGQGTLVTVSSAS

SEQ ID NO: 3249 - protein, 123 aa, Artificial Sequence
  VH3-23_IGHD4-4*01(1)_1>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYSNYSYNWFDYWGQGTLVTVSSAS

SEQ ID NO: 3250 - protein, 123 aa, Artificial Sequence
  VH3-23_IGHD4-4*01(1)_1>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVTSYNWFDYWGQGTLVTVSSAS

SEQ ID NO: 3251 - protein, 123 aa, Artificial Sequence; identical to SEQ ID NO: 3249
  VH3-23_IGHD4-11*01(1)_1>2_IGHJ5*01

SEQ ID NO: 3252 - protein, 123 aa, Artificial Sequence; identical to SEQ ID NO: 3250
  VH3-23_IGHD4-11*01(1)_1>3_IGHJ5*01

SEQ ID NO: 3253 - protein, 123 aa, Artificial Sequence
  VH3-23_IGHD4-17*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGDYSYNWFDYWGQGTLVTVSSAS

SEQ ID NO: 3254 - protein, 123 aa, Artificial Sequence; identical to SEQ ID NO: 3250
  VH3-23_IGHD4-17*01>3_IGHJ5*01

SEQ ID NO: 3255 - protein, 124 aa, Artificial Sequence
  VH3-23_IGHD4-23*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGGNSSYNWFDYWGQGTLVTVSSAS

SEQ ID NO: 3256 - protein, 124 aa, Artificial Sequence
  VH3-23_IGHD4-23*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVVTSYNWFDYWGQGTLVTVSSAS

SEQ ID NO: 3257 - protein, 125 aa, Artificial Sequence
  VH3-23_IGHD5-5*01(2)_1>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDTAMVTSYNWFDYWGQGTLVTVSSAS

SEQ ID NO: 3258 - protein, 125 aa, Artificial Sequence
  VH3-23_IGHD5-5*01(2)_1>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWIQLWLRSYNWFDYWGQGTLVTVSSAS

SEQ ID NO: 3259 - protein, 125 aa, Artificial Sequence
  VH3-23_IGHD5-5*01(2)_1>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSYGYSYNWFDYWGQGTLVTVSSAS

SEQ ID NO: 3260 - protein, 126 aa, Artificial Sequence
  VH3-23_IGHD5-12*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDIVATITSYNWFDYWGQGTLVTVSSAS

SEQ ID NO: 3261 - protein, 126 aa, Artificial Sequence
  VH3-23_IGHD5-12*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSGYDYSYNWFDYWGQGTLVTVSSAS

SEQ ID NO: 3262 - protein, 125 aa, Artificial Sequence; identical to SEQ ID NO: 3257
  VH3-23_IGHD5-18*01(2)_1>1_IGHJ5*01

SEQ ID NO: 3263 - protein, 125 aa, Artificial Sequence; identical to SEQ ID NO: 3258
  VH3-23_IGHD5-18*01(2)_1>2_IGHJ5*01

SEQ ID NO: 3264 - protein, 125 aa, Artificial Sequence; identical to SEQ ID NO: 3259
  VH3-23_IGHD5-18*01(2)_1>3_IGHJ5*01

SEQ ID NO: 3265 - protein, 125 aa, Artificial Sequence
  VH3-23_IGHD5-24*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVEMATITSYNWFDYWGQGTLVTVSSAS

SEQ ID NO: 3266 - protein, 125 aa, Artificial Sequence
  VH3-23_IGHD5-24*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRDGYNYSYNWFDYWGQGTLVTVSSAS

SEQ ID NO: 3267 - protein, 124 aa, Artificial Sequence
  VH3-23_IGHD6-6*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEYSSSSSYNWFDYWGQGTLVTVSSAS

SEQ ID NO: 3268 - protein, 124 aa, Artificial Sequence
  VH3-23_IGHD6-6*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSIAARPSYNWFDYWGQGTLVTVSSAS

SEQ ID NO: 3269 - protein, 125 aa, Artificial Sequence
  VH3-23_IGHD6-13*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSSWYSYNWFDYWGQGTLVTVSSAS

SEQ ID NO: 3270 - protein, 125 aa, Artificial Sequence
  VH3-23_IGHD6-13*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAAGTSYNWFDYWGQGTLVTVSSAS

SEQ ID NO: 3271 - protein, 125 aa, Artificial Sequence
  VH3-23_IGHD6-19*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGWYSYNWFDYWGQGTLVTVSSAS

SEQ ID NO: 3272 - protein, 125 aa, Artificial Sequence
  VH3-23_IGHD6-19*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAVAGTSYNWFDYWGQGTLVTVSSAS

SEQ ID NO: 3273 - protein, 124 aa, Artificial Sequence
  VH3-23_IGHD6-25*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGYSYNWFDYWGQGTLVTVSSAS

SEQ ID NO: 3274 - protein, 124 aa, Artificial Sequence
  VH3-23_IGHD6-25*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAATSYNWFDYWGQGTLVTVSSAS

SEQ ID NO: 3275 - protein, 122 aa, Artificial Sequence
  VH3-23_IGHD7-27*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKLTGESYNWFDYWGQGTLVTVSSAS

SEQ ID NO: 3276 - protein, 122 aa, Artificial Sequence
  VH3-23_IGHD7-27*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKANWGSYNWFDYWGQGTLVTVSSAS

SEQ ID NO: 3277 - protein, 124 aa, Artificial Sequence
  VH3-23_IGHD1-1*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVVPSYNWFDYWGQGTLVTVSSAS

SEQ ID NO: 3278 - protein, 124 aa, Artificial Sequence
  VH3-23_IGHD1-1*01>2'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSFQLYRSYNWFDYWGQGTLVTVSSAS

SEQ ID NO: 3279 - protein, 124 aa, Artificial Sequence
  VH3-23_IGHD1-1*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSCTSYNWFDYWGQGTLVTVSSAS

SEQ ID NO: 3280 - protein, 124 aa, Artificial Sequence
  VH3-23_IGHD1-7*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVIPSYNWFDYWGQGTLVTVSSAS

SEQ ID NO: 3281 - protein, 124 aa, Artificial Sequence
  VH3-23_IGHD1-7*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYTSYNWFDYWGQGTLVTVSSAS

SEQ ID NO: 3282 - protein, 124 aa, Artificial Sequence; identical to SEQ ID NO: 3280
  VH3-23_IGHD1-14*01>1'_IGHJ5*01

SEQ ID NO: 3283 - protein, 124 aa, Artificial Sequence
  VH3-23_IGHD1-14*01>2'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWFRLYRSYNWFDYWGQGTLVTVSSAS

SEQ ID NO: 3284 - protein, 124 aa, Artificial Sequence
  VH3-23_IGHD1-14*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGSGYTSYNWFDYWGQGTLVTVSSAS

SEQ ID NO: 3285 - protein, 124 aa, Artificial Sequence; identical to SEQ ID NO: 3280
  VH3-23_IGHD1-20*01>1'_IGHJ5*01

SEQ ID NO: 3286 - protein, 124 aa, Artificial Sequence; identical to SEQ ID NO: 3278
  VH3-23_IGHD1-20*01>2'_IGHJ5*01

SEQ ID NO: 3287 - protein, 124 aa, Artificial Sequence
  VH3-23_IGHD1-20*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSYTSYNWFDYWGQGTLVTVSSAS

SEQ ID NO: 3288 - protein, 125 aa, Artificial Sequence
  VH3-23_IGHD1-26*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVAPTIPSYNWFDYWGQGTLVTVSSAS

SEQ ID NO: 3289 - protein, 125 aa, Artificial Sequence
  VH3-23_IGHD1-26*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSHYTSYNWFDYWGQGTLVTVSSAS

SEQ ID NO: 3290 - protein, 128 aa, Artificial Sequence
  VH3-23_IGHD2-2*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAGTTTISSYNWFDYWGQGTLVTVSSAS

SEQ ID NO: 3291 - protein, 128 aa, Artificial Sequence
  VH3-23_IGHD2-2*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGHSSWYYYNISYNWFDYWGQGTLVTVSSAS

SEQ ID NO: 3292 - protein, 128 aa, Artificial Sequence
  VH3-23_IGHD2-8*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAYTISTISSYNWFDYWGQGTLVTVSSAS

SEQ ID NO: 3293 - protein, 128 aa, Artificial Sequence
  VH3-23_IGHD2-15*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVAATTTTISSYNWFDYWGQGTLVTVSSAS

SEQ ID NO: 3294 - protein, 128 aa, Artificial Sequence
  VH3-23_IGHD2-15*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYHHYNISYNWFDYWGQGTLVTVSSAS

SEQ ID NO: 3295 - protein, 127 aa, Artificial Sequence
  VH3-23_IGHD2-21*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAITTTICSYNWFDYWGQGTLVTVSSAS

SEQ ID NO: 3296 - protein, 127 aa, Artificial Sequence
  VH3-23_IGHD2-21*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNSNHHHNMSYNWFDYWGQGTLVTVSSAS

SEQ ID NO: 3297 - protein, 128 aa, Artificial Sequence
  VH3-23_IGHD3-3*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIITTPKIVISYNWFDYWGQGTLVTVSSAS

SEQ ID NO: 3298 - protein, 128 aa, Artificial Sequence
  VH3-23_IGHD3-3*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNHSKNRNSYNWFDYWGQGTLVTVSSAS

SEQ ID NO: 3299 - protein, 128 aa, Artificial Sequence
  VH3-23_IGHD3-9*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITSQNIVISYNWFDYWGQGTLVTVSSAS

SEQ ID NO: 3300 - protein, 128 aa, Artificial Sequence
  VH3-23_IGHD3-9*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNQSKYRNSYNWFDYWGQGTLVTVSSAS

SEQ ID NO: 3301 - protein, 128 aa, Artificial Sequence
  VH3-23_IGHD3-10*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITPRTIVISYNWFDYWGQGTLVTVSSAS

SEQ ID NO: 3302 - protein, 128 aa, Artificial Sequence
  VH3-23_IGHD3-10*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNSPNHSNSYNWFDYWGQGTLVTVSSAS

SEQ ID NO: 3303 - protein, 130 aa, Artificial Sequence
  VH3-23_IGHD3-16*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGISITPPNVIIISYNWFDYWGQGTLVTVSSAS

SEQ ID NO: 3304 - protein, 130 aa, Artificial Sequence
  VH3-23_IGHD3-16*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYKHNSPKRNHNSYNWFDYWGQGTLVTVSSAS

SEQ ID NO: 3305 - protein, 128 aa, Artificial Sequence
  VH3-23_IGHD3-22*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVITTTIIVISYNWFDYWGQGTLVTVSSAS

SEQ ID NO: 3306 - protein, 123 aa, Artificial Sequence
  VH3-23_IGHD4-4*01(1)_1>1'_IGHJ5*
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVTVVSYNWFDYWGQGTLVTVSSAS

SEQ ID NO: 3307 - protein, 123 aa, Artificial Sequence
  VH3-23_IGHD4-4*01(1)_1>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYCSSYNWFDYWGQGTLVTVSSAS

SEQ ID NO: 3308 - protein, 123 aa, Artificial Sequence; identical to SEQ ID NO: 3306
  VH3-23_IGHD4-11*01(1)_1>1'_IGHJ5*01

SEQ ID NO: 3309 - protein, 123 aa, Artificial Sequence; identical to SEQ ID NO: 3307
  VH3-23_IGHD4-11*01(1)_1>3'_IGHJ5*01

SEQ ID NO: 3310 - protein, 123 aa, Artificial Sequence; identical to SEQ ID NO: 3306
  VH3-23_IGHD4-17*01>1'_IGHJ5*01

SEQ ID NO: 3311 - protein, 123 aa, Artificial Sequence
  VH3-23_IGHD4-17*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSHRSSYNWFDYWGQGTLVTVSSAS

SEQ ID NO: 3312 - protein, 124 aa, Artificial Sequence
  VH3-23_IGHD4-23*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVTTVVSYNWFDYWGQGTLVTVSSAS

SEQ ID NO: 3313 - protein, 124 aa, Artificial Sequence
  VH3-23_IGHD4-23*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYHRSSYNWFDYWGQGTLVTVSSAS

SEQ ID NO: 3314 - protein, 125 aa, Artificial Sequence
  VH3-23_IGHD5-5*01(2)_1>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTIAVSTSYNWFDYWGQGTLVTVSSAS

SEQ ID NO: 3315 - protein, 125 aa, Artificial Sequence
  VH3-23_IGHD5-5*01(2)_1>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNHSCIHSYNWFDYWGQGTLVTVSSAS

SEQ ID NO: 3316 - protein, 126 aa, Artificial Sequence
  VH3-23_IGHD5-12*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVATISTSYNWFDYWGQGTLVTVSSAS

SEQ ID NO: 3317 - protein, 126 aa, Artificial Sequence
  VH3-23_IGHD5-12*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNRSHYIHSYNWFDYWGQGTLVTVSSAS

SEQ ID NO: 3318 - protein, 125 aa, Artificial Sequence; identical to SEQ ID NO: 3314
  VH3-23_IGHD5-18*01(2)_1>1'_IGHJ5*01

SEQ ID NO: 3319 - protein, 125 aa, Artificial Sequence; identical to SEQ ID NO: 3315
  VH3-23_IGHD5-18*01(2)_1>3'_IGHJ5*01

SEQ ID NO: 3320 - protein, 125 aa, Artificial Sequence
  VH3-23_IGHD5-24*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVAISTSYNWFDYWGQGTLVTVSSAS

SEQ ID NO: 3321 - protein, 125 aa, Artificial Sequence
  VH3-23_IGHD5-24*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNCSHLYSYNWFDYWGQGTLVTVSSAS

SEQ ID NO: 3322 - protein, 124 aa, Artificial Sequence
  VH3-23_IGHD6-6*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRAAILSYNWFDYWGQGTLVTVSSAS

SEQ ID NO: 3323 - protein, 124 aa, Artificial Sequence
  VH3-23_IGHD6-6*01>2'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDELLYSSYNWFDYWGQGTLVTVSSAS

SEQ ID NO: 3324 - protein, 124 aa, Artificial Sequence
  VH3-23_IGHD6-6*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCYTSYNWFDYWGQGTLVTVSSAS

SEQ ID NO: 3325 - protein, 125 aa, Artificial Sequence
  VH3-23_IGHD6-13*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPAAAIPSYNWFDYWGQGTLVTVSSAS

SEQ ID NO: 3326 - protein, 125 aa, Artificial Sequence
  VH3-23_IGHD6-13*01>2'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQLLLYPSYNWFDYWGQGTLVTVSSAS

SEQ ID NO: 3327 - protein, 125 aa, Artificial Sequence
  VH3-23_IGHD6-13*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCCYTSYNWFDYWGQGTLVTVSSAS

SEQ ID NO: 3328 - protein, 125 aa, Artificial Sequence
  VH3-23_IGHD6-19*01>1'_IGHJ5*0
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPATAIPSYNWFDYWGQGTLVTVSSAS

SEQ ID NO: 3329 - protein, 125 aa, Artificial Sequence
  VH3-23_IGHD6-19*01>2'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQPLLYPSYNWFDYWGQGTLVTVSSAS

SEQ ID NO: 3330 - protein, 125 aa, Artificial Sequence
  VH3-23_IGHD6-19*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSHCYTSYNWFDYWGQGTLVTVSSAS

SEQ ID NO: 3331 - protein, 124 aa, Artificial Sequence
  VH3-23_IGHD6-25*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVAAAIPSYNWFDYWGQGTLVTVSSAS

SEQ ID NO: 3332 - protein, 124 aa, Artificial Sequence
  VH3-23_IGHD6-25*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSRCYTSYNWFDYWGQGTLVTVSSAS

SEQ ID NO: 3333 - protein, 122 aa, Artificial Sequence
  VH3-23_IGHD7-27*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSPVRSYNWFDYWGQGTLVTVSSAS

SEQ ID NO: 3334 - protein, 122 aa, Artificial Sequence
  VH3-23_IGHD7-27*01>2'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKPQLGSYNWFDYWGQGTLVTVSSAS

SEQ ID NO: 3335 - protein, 128 aa, Artificial Sequence
  VH3-23_IGHD1-1*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTTGTTSYYYYYYGMDVWGQGTLVTVSSAS

SEQ ID NO: 3336 - protein, 128 aa, Artificial Sequence
  VH3-23_IGHD1-1*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVQLERRSYYYYYYGMDVWGQGTLVTVSSAS

SEQ ID NO: 3337 - protein, 128 aa, Artificial Sequence
  VH3-23_IGHD1-1*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNDSYYYYYYGMDVWGQGTLVTVSSAS

SEQ ID NO: 3338 - protein, 128 aa, Artificial Sequence
  VH3-23_IGHD1-7*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITGTTSYYYYYYGMDVWGQGTLVTVSSAS

SEQ ID NO: 3339 - protein, 128 aa, Artificial Sequence
  VH3-23_IGHD1-7*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNYSYYYYYYGMDVWGQGTLVTVSSAS

SEQ ID NO: 3340 - protein, 128 aa, Artificial Sequence; identical to SEQ ID NO: 3338
  VH3-23_IGHD1-14*01>1_IGHJ6*01

SEQ ID NO: 3341 - protein, 128 aa, Artificial Sequence
  VH3-23_IGHD1-14*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNRNHSYYYYYYGMDVWGQGTLVTVSSAS

SEQ ID NO: 3342 - protein, 128 aa, Artificial Sequence; identical to SEQ ID NO: 3338
  VH3-23_IGHD1-20*01>1_IGHJ6*01

SEQ ID NO: 3343 - protein, 128 aa, Artificial Sequence; identical to SEQ ID NO: 3337
  VH3-23_IGHD1-20*01>3_IGHJ6*01

SEQ ID NO: 3344 - protein, 129 aa, Artificial Sequence
  VH3-23_IGHD1-26*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIVGATTSYYYYYYGMDVWGQGTLVTVSSAS

SEQ ID NO: 3345 - protein, 129 aa, Artificial Sequence
  VH3-23_IGHD1-26*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSGSYYSYYYYYYGMDVWGQGTLVTVSSAS

SEQ ID NO: 3346 - protein, 132 aa, Artificial Sequence
  VH3-23_IGHD2-2*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSSTSCYASYYYYYYGMDVWGQGTLVTVSSAS

SEQ ID NO: 3347 - protein, 132 aa, Artificial Sequence
  VH3-23_IGHD2-2*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVPAAMSYYYYYYGMDVWGQGTLVTVSSAS

SEQ ID NO: 3348 - protein, 132 aa, Artificial Sequence
  VH3-23_IGHD2-8*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCTNGVCYTSYYYYYYGMDVWGQGTLVTVSSAS

SEQ ID NO: 3349 - protein, 132 aa, Artificial Sequence
  VH3-23_IGHD2-8*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVLMVYAISYYYYYYGMDVWGQGTLVTVSSAS

SEQ ID NO: 3350 - protein, 132 aa, Artificial Sequence
  VH3-23_IGHD2-15*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSGGSCYSSYYYYYYGMDVWGQGTLVTVSSAS

SEQ ID NO: 3351 - protein, 132 aa, Artificial Sequence
  VH3-23_IGHD2-15*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVVAATSYYYYYYGMDVWGQGTLVTVSSAS

SEQ ID NO: 3352 - protein, 131 aa, Artificial Sequence
  VH3-23_IGHD2-21*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKAYCGGDCYSSYYYYYYGMDVWGQGTLVTVSSAS

SEQ ID NO: 3353 - protein, 131 aa, Artificial Sequence
  VH3-23_IGHD2-21*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVIAISYYYYYYGMDVWGQGTLVTVSSAS

SEQ ID NO: 3354 - protein, 132 aa, Artificial Sequence
  VH3-23_IGHD3-3*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVLRFLEWLLYSYYYYYYGMDVWGQGTLVTVSSAS

SEQ ID NO: 3355 - protein, 132 aa, Artificial Sequence
  VH3-23_IGHD3-3*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDFWSGYYTSYYYYYYGMDVWGQGTLVTVSSAS

SEQ ID NO: 3356 - protein, 132 aa, Artificial Sequence
  VH3-23_IGHD3-3*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITIFGVVIISYYYYYYGMDVWGQGTLVTVSSAS

SEQ ID NO: 3357 - protein, 132 aa, Artificial Sequence
  VH3-23_IGHD3-9*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDILTGYYNSYYYYYYGMDVWGQGTLVTVSSAS

SEQ ID NO: 3358 - protein, 132 aa, Artificial Sequence
  VH3-23_IGHD3-10*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYGSGSYYNSYYYYYYGMDVWGQGTLVTVSSAS

SEQ ID NO: 3359 - protein, 132 aa, Artificial Sequence
  VH3-23_IGHD3-10*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYYYYGMDVWGQGTLVTVSSAS

SEQ ID NO: 3360 - protein, 134 aa, Artificial Sequence
  VH3-23_IGHD3-16*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDYVWGSYAYTSYYYYYYGMDVWGQGTLVTVSSAS

SEQ ID NO: 3361 - protein, 134 aa, Artificial Sequence
  VH3-23_IGHD3-16*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIMITFGGVMLISYYYYYYGMDVWGQGTLVTVSSAS

SEQ ID NO: 3362 - protein, 132 aa, Artificial Sequence
  VH3-23_IGHD3-22*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYDSSGYYYSYYYYYYGMDVWGQGTLVTVSSAS

SEQ ID NO: 3363 - protein, 132 aa, Artificial Sequence
  VH3-23_IGHD3-22*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMIVVVITSYYYYYYGMDVWGQGTLVTVSSAS

SEQ ID NO: 3364 - protein, 127 aa, Artificial Sequence
  VH3-23_IGHD4-4*01(1)_1>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYSNYSYYYYYYGMDVWGQGTLVTVSSAS

SEQ ID NO: 3365 - protein, 127 aa, Artificial Sequence
  VH3-23_IGHD4-4*01(1)_1>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVTSYYYYYYGMDVWGQGTLVTVSSAS

SEQ ID NO: 3366 - protein, 127 aa, Artificial Sequence; identical to SEQ ID NO: 3364
  VH3-23_IGHD4-11*01(1)_1>2_IGHJ6*01

SEQ ID NO: 3367 - protein, 127 aa, Artificial Sequence; identical to SEQ ID NO: 3365
  VH3-23_IGHD4-11*01(1)_1>3_IGHJ6*01

SEQ ID NO: 3368 - protein, 127 aa, Artificial Sequence
  VH3-23_IGHD4-17*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGDYSYYYYYYGMDVWGQGTLVTVSSAS

SEQ ID NO: 3369 - protein, 127 aa, Artificial Sequence; identical to SEQ ID NO: 3365
  VH3-23_IGHD4-17*01>3_IGHJ6*01

SEQ ID NO: 3370 - protein, 128 aa, Artificial Sequence
  VH3-23_IGHD4-23*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGGNSSYYYYYYGMDVWGQGTLVTVSSAS

SEQ ID NO: 3371 - protein, 128 aa, Artificial Sequence
  VH3-23_IGHD4-23*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVVTSYYYYYYGMDVWGQGTLVTVSSAS

SEQ ID NO: 3372 - protein, 129 aa, Artificial Sequence
  VH3-23_IGHD5-5*01(2)_1>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDTAMVTSYYYYYYGMDVWGQGTLVTVSSAS

SEQ ID NO: 3373 - protein, 129 aa, Artificial Sequence
  VH3-23_IGHD5-5*01(2)_1>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWIQLWLRSYYYYYYGMDVWGQGTLVTVSSAS

SEQ ID NO: 3374 - protein, 129 aa, Artificial Sequence
  VH3-23_IGHD5-5*01(2)_1>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSYGYSYYYYYYGMDVWGQGTLVTVSSAS

SEQ ID NO: 3375 - protein, 130 aa, Artificial Sequence
  VH3-23_IGHD5-12*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDIVATITSYYYYYYGMDVWGQGTLVTVSSAS

SEQ ID NO: 3376 - protein, 130 aa, Artificial Sequence
  VH3-23_IGHD5-12*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSGYDYSYYYYYYGMDVWGQGTLVTVSSAS

SEQ ID NO: 3377 - protein, 129 aa, Artificial Sequence; identical to SEQ ID NO: 3372
  VH3-23_IGHD5-18*01(2)_1>1_IGHJ6*01

SEQ ID NO: 3378 - protein, 129 aa, Artificial Sequence; identical to SEQ ID NO: 3373
  VH3-23_IGHD5-18*01(2)_1>2_IGHJ6*01

SEQ ID NO: 3379 - protein, 129 aa, Artificial Sequence; identical to SEQ ID NO: 3374
  VH3-23_IGHD5-18*01(2)_1>3_IGHJ6*01

SEQ ID NO: 3380 - protein, 129 aa, Artificial Sequence
  VH3-23_IGHD5-24*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVEMATITSYYYYYYGMDVWGQGTLVTVSSAS

SEQ ID NO: 3381 - protein, 129 aa, Artificial Sequence
  VH3-23_IGHD5-24*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRDGYNYSYYYYYYGMDVWGQGTLVTVSSAS

SEQ ID NO: 3382 - protein, 128 aa, Artificial Sequence
  VH3-23_IGHD6-6*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEYSSSSSYYYYYYGMDVWGQGTLVTVSSAS

SEQ ID NO: 3383 - protein, 128 aa, Artificial Sequence
  VH3-23_IGHD6-6*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSIAARPSYYYYYYGMDVWGQGTLVTVSSAS

SEQ ID NO: 3384 - protein, 129 aa, Artificial Sequence
  VH3-23_IGHD6-13*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSSWYSYYYYYYGMDVWGQGTLVTVSSAS

SEQ ID NO: 3385 - protein, 129 aa, Artificial Sequence
  VH3-23_IGHD6-13*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAAGTSYYYYYYGMDVWGQGTLVTVSSAS

SEQ ID NO: 3386 - protein, 129 aa, Artificial Sequence
  VH3-23_IGHD6-19*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGWYSYYYYYYGMDVWGQGTLVTVSSAS

SEQ ID NO: 3387 - protein, 129 aa, Artificial Sequence
  VH3-23_IGHD6-19*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAVAGTSYYYYYYGMDVWGQGTLVTVSSAS

SEQ ID NO: 3388 - protein, 128 aa, Artificial Sequence
  VH3-23_IGHD6-25*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGYSYYYYYYGMDVWGQGTLVTVSSAS

SEQ ID NO: 3389 - protein, 128 aa, Artificial Sequence
  VH3-23_IGHD6-25*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAATSYYYYYYGMDVWGQGTLVTVSSAS

SEQ ID NO: 3390 - protein, 126 aa, Artificial Sequence
  VH3-23_IGHD7-27*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKLTGESYYYYYYGMDVWGQGTLVTVSSAS

SEQ ID NO: 3391 - protein, 126 aa, Artificial Sequence
  VH3-23_IGHD7-27*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKANWGSYYYYYYGMDVWGQGTLVTVSSAS

SEQ ID NO: 3392 - protein, 128 aa, Artificial Sequence
  VH3-23_IGHD1-1*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVVPSYYYYYYGMDVWGQGTLVTVSSAS

SEQ ID NO: 3393 - protein, 128 aa, Artificial Sequence
  VH3-23_IGHD1-1*01>2'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSFQLYRSYYYYYYGMDVWGQGTLVTVSSAS

SEQ ID NO: 3394 - protein, 128 aa, Artificial Sequence
  VH3-23_IGHD1-1*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSCTSYYYYYYGMDVWGQGTLVTVSSAS

SEQ ID NO: 3395 - protein, 128 aa, Artificial Sequence
  VH3-23_IGHD1-7*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVIPSYYYYYYGMDVWGQGTLVTVSSAS

SEQ ID NO: 3396 - protein, 128 aa, Artificial Sequence
  VH3-23_IGHD1-7*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYTSYYYYYYGMDVWGQGTLVTVSSAS

SEQ ID NO: 3397 - protein, 128 aa, Artificial Sequence; identical to SEQ ID NO: 3395
  VH3-23_IGHD1-14*01>1'_IGHJ6*01

SEQ ID NO: 3398 - protein, 128 aa, Artificial Sequence
  VH3-23_IGHD1-14*01>2'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWFRLYRSYYYYYYGMDVWGQGTLVTVSSAS

SEQ ID NO: 3399 - protein, 128 aa, Artificial Sequence
  VH3-23_IGHD1-14*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGSGYTSYYYYYYGMDVWGQGTLVTVSSAS

SEQ ID NO: 3400 - protein, 128 aa, Artificial Sequence; identical to SEQ ID NO: 3395
  VH3-23_IGHD1-20*01>1'_IGHJ6*01

SEQ ID NO: 3401 - protein, 128 aa, Artificial Sequence; identical to SEQ ID NO: 3393
  VH3-23_IGHD1-20*01>2'_IGHJ6*01

SEQ ID NO: 3402 - protein, 128 aa, Artificial Sequence
  VH3-23_IGHD1-20*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSYTSYYYYYYGMDVWGQGTLVTVSSAS

SEQ ID NO: 3403 - protein, 129 aa, Artificial Sequence
  VH3-23_IGHD1-26*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVAPTIPSYYYYYYGMDVWGQGTLVTVSSAS

SEQ ID NO: 3404 - protein, 129 aa, Artificial Sequence
  VH3-23_IGHD1-26*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSHYTSYYYYYYGMDVWGQGTLVTVSSAS

SEQ ID NO: 3405 - protein, 132 aa, Artificial Sequence
  VH3-23_IGHD2-2*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAGTTTISSYYYYYYGMDVWGQGTLVTVSSAS

SEQ ID NO: 3406 - protein, 132 aa, Artificial Sequence
  VH3-23_IGHD2-2*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGHSSWYYYNISYYYYYYGMDVWGQGTLVTVSSAS

SEQ ID NO: 3407 - protein, 132 aa, Artificial Sequence
  VH3-23_IGHD2-8*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAYTISTISSYYYYYYGMDVWGQGTLVTVSSAS

SEQ ID NO: 3408 - protein, 132 aa, Artificial Sequence
  VH3-23_IGHD2-15*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVAATTTTISSYYYYYYGMDVWGQGTLVTVSSAS

SEQ ID NO: 3409 - protein, 132 aa, Artificial Sequence
  VH3-23_IGHD2-15*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYHHYNISYYYYYYGMDVWGQGTLVTVSSAS

SEQ ID NO: 3410 - protein, 131 aa, Artificial Sequence
  VH3-23_IGHD2-21*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAITTTICSYYYYYYGMDVWGQGTLVTVSSAS

SEQ ID NO: 3411 - protein, 131 aa, Artificial Sequence
  VH3-23_IGHD2-21*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNSNHHHNMSYYYYYYGMDVWGQGTLVTVSSAS

SEQ ID NO: 3412 - protein, 132 aa, Artificial Sequence
  VH3-23_IGHD3-3*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIITTPKIVISYYYYYYGMDVWGQGTLVTVSSAS

SEQ ID NO: 3413 - protein, 132 aa, Artificial Sequence
  VH3-23_IGHD3-3*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNHSKNRNSYYYYYYGMDVWGQGTLVTVSSAS

SEQ ID NO: 3414 - protein, 132 aa, Artificial Sequence
  VH3-23_IGHD3-9*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITSQNIVISYYYYYYGMDVWGQGTLVTVSSAS

SEQ ID NO: 3415 - protein, 132 aa, Artificial Sequence
  VH3-23_IGHD3-9*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNQSKYRNSYYYYYYGMDVWGQGTLVTVSSAS

SEQ ID NO: 3416 - protein, 132 aa, Artificial Sequence
  VH3-23_IGHD3-10*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITPRTIVISYYYYYYGMDVWGQGTLVTVSSAS

SEQ ID NO: 3417 - protein, 132 aa, Artificial Sequence
  VH3-23_IGHD3-10*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNSPNHSNSYYYYYYGMDVWGQGTLVTVSSAS

SEQ ID NO: 3418 - protein, 134 aa, Artificial Sequence
  VH3-23_IGHD3-16*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGISITPPNVIIISYYYYYYGMDVWGQGTLVTVSSAS

SEQ ID NO: 3419 - protein, 134 aa, Artificial Sequence
  VH3-23_IGHD3-16*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYKHNSPKRNHNSYYYYYYGMDVWGQGTLVTVSSAS

SEQ ID NO: 3420 - protein, 132 aa, Artificial Sequence
  VH3-23_IGHD3-22*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVITTTIIVISYYYYYYGMDVWGQGTLVTVSSAS

SEQ ID NO: 3421 - protein, 127 aa, Artificial Sequence
  VH3-23_IGHD4-4*01(1)_1>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVTVVSYYYYYYGMDVWGQGTLVTVSSAS

SEQ ID NO: 3422 - protein, 127 aa, Artificial Sequence
  VH3-23_IGHD4-4*01(1)_1>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYCSSYYYYYYGMDVWGQGTLVTVSSAS

SEQ ID NO: 3423 - protein, 127 aa, Artificial Sequence; identical to SEQ ID NO: 3421
  VH3-23_IGHD4-11*01(1)_1>1'_IGHJ6*01

SEQ ID NO: 3424 - protein, 127 aa, Artificial Sequence; identical to SEQ ID NO: 3422
  VH3-23_IGHD4-11*01(1)_1>3'_IGHJ6*01

SEQ ID NO: 3425 - protein, 127 aa, Artificial Sequence; identical to SEQ ID NO: 3421
  VH3-23_IGHD4-17*01>1'_IGHJ6*01

SEQ ID NO: 3426 - protein, 127 aa, Artificial Sequence
  VH3-23_IGHD4-17*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSHRSSYYYYYYGMDVWGQGTLVTVSSAS

SEQ ID NO: 3427 - protein, 128 aa, Artificial Sequence
  VH3-23_IGHD4-23*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVTTVVSYYYYYYGMDVWGQGTLVTVSSAS

SEQ ID NO: 3428 - protein, 128 aa, Artificial Sequence
  VH3-23_IGHD4-23*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYHRSSYYYYYYGMDVWGQGTLVTVSSAS

SEQ ID NO: 3429 - protein, 129 aa, Artificial Sequence
  VH3-23_IGHD5-5*01(2)_1>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTIAVSTSYYYYYYGMDVWGQGTLVTVSSAS

SEQ ID NO: 3430 - protein, 129 aa, Artificial Sequence
  VH3-23_IGHD5-5*01(2)_1>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNHSCIHSYYYYYYGMDVWGQGTLVTVSSAS

SEQ ID NO: 3431 - protein, 130 aa, Artificial Sequence
  VH3-23_IGHD5-12*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVATISTSYYYYYYGMDVWGQGTLVTVSSAS

SEQ ID NO: 3432 - protein, 130 aa, Artificial Sequence
  VH3-23_IGHD5-12*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNRSHYIHSYYYYYYGMDVWGQGTLVTVSSAS

SEQ ID NO: 3433 - protein, 129 aa, Artificial Sequence; identical to SEQ ID NO: 3429
  VH3-23_IGHD5-18*01(2)_1>1'_IGHJ6*01

SEQ ID NO: 3434 - protein, 129 aa, Artificial Sequence; identical to SEQ ID NO: 3430
  VH3-23_IGHD5-18*01(2)_1>3'_IGHJ6*01

SEQ ID NO: 3435 - protein, 129 aa, Artificial Sequence
  VH3-23_IGHD5-24*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVAISTSYYYYYYGMDVWGQGTLVTVSSAS

SEQ ID NO: 3436 - protein, 129 aa, Artificial Sequence
  VH3-23_IGHD5-24*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNCSHLYSYYYYYYGMDVWGQGTLVTVSSAS

SEQ ID NO: 3437 - protein, 128 aa, Artificial Sequence
  VH3-23_IGHD6-6*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRAAILSYYYYYYGMDVWGQGTLVTVSSAS

SEQ ID NO: 3438 - protein, 128 aa, Artificial Sequence
  VH3-23_IGHD6-6*01>2'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDELLYSSYYYYYYGMDVWGQGTLVTVSSAS

SEQ ID NO: 3439 - protein, 128 aa, Artificial Sequence
  VH3-23_IGHD6-6*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCYTSYYYYYYGMDVWGQGTLVTVSSAS

SEQ ID NO: 3440 - protein, 129 aa, Artificial Sequence
  VH3-23_IGHD6-13*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPAAAIPSYYYYYYGMDVWGQGTLVTVSSAS

SEQ ID NO: 3441 - protein, 129 aa, Artificial Sequence
  VH3-23_IGHD6-13*01>2'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQLLLYPSYYYYYYGMDVWGQGTLVTVSSAS

SEQ ID NO: 3442 - protein, 129 aa, Artificial Sequence
  VH3-23_IGHD6-13*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCCYTSYYYYYYGMDVWGQGTLVTVSSAS

SEQ ID NO: 3443 - protein, 129 aa, Artificial Sequence
  VH3-23_IGHD6-19*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPATAIPSYYYYYYGMDVWGQGTLVTVSSAS

SEQ ID NO: 3444 - protein, 129 aa, Artificial Sequence
  VH3-23_IGHD6-19*01>2'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQPLLYPSYYYYYYGMDVWGQGTLVTVSSAS

SEQ ID NO: 3445 - protein, 129 aa, Artificial Sequence
  VH3-23_IGHD6-19*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSHCYTSYYYYYYGMDVWGQGTLVTVSSAS

SEQ ID NO: 3446 - protein, 128 aa, Artificial Sequence
  VH3-23_IGHD6-25*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVAAAIPSYYYYYYGMDVWGQGTLVTVSSAS

SEQ ID NO: 3447 - protein, 128 aa, Artificial Sequence
  VH3-23_IGHD6-25*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSRCYTSYYYYYYGMDVWGQGTLVTVSSAS

SEQ ID NO: 3448 - protein, 126 aa, Artificial Sequence
  VH3-23_IGHD7-27*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSPVRSYYYYYYGMDVWGQGTLVTVSSAS

SEQ ID NO: 3449 - protein, 126 aa, Artificial Sequence
  VH3-23_IGHD7-27*01>2'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKPQLGSYYYYYYGMDVWGQGTLVTVSSAS

SEQ ID NO: 3450 - DNA, 52 bp, Artificial Sequence
  IGHJ1
gctgaatacttccagcactggggccaaggaaccctggtcaccgtctcctcag

SEQ ID NO: 3451 - DNA, 53 bp, Artificial Sequence
  IGHJ2
ctactggtacttcgattcctggggccaaggaaccctggtcaccgtctcctcag

SEQ ID NO: 3452 - DNA, 47 bp, Artificial Sequence
  IGHJ3
tgcttttgatgtctggggccaaggaaccctggtcaccgtctcctcag

SEQ ID NO: 3453 - DNA, 48 bp, Artificial Sequence; identical to SEQ ID NO: 277
  IGHJ4

SEQ ID NO: 3454 - DNA, 51 bp, Artificial Sequence
  IGHJ5
acaactggttcgactactggggccaaggaaccctggtcaccgtctcctcag

SEQ ID NO: 3455 - DNA, 63 bp, Artificial Sequence
  IGHJ6
attactactactactacggtatggacgtctggggccaaggaaccctggtcaccgtctcctcag

SEQ ID NO: 3456 - protein, 19 aa, Artificial Sequence
  IGHJ1
AEYFQHWGQGTLVTVSSAS

SEQ ID NO: 3457 - protein, 19 aa, Artificial Sequence
  IGHJ2
YWYFDSWGQGTLVTVSSAS

SEQ ID NO: 3458 - protein, 17 aa, Artificial Sequence
  IGHJ3
AFDVWGQGTLVTVSSAS

SEQ ID NO: 3459 - protein, 17 aa, Artificial Sequence
  IGHJ4
YFDYWGQGTLVTVSSAS

SEQ ID NO: 3460 - protein, 18 aa, Artificial Sequence
  IGHJ5
NWFDYWGQGTLVTVSSAS

SEQ ID NO: 3461 - protein, 22 aa, Artificial Sequence
  IGHJ6
YYYYYGMDVWGQGTLVTVSSAS

SEQ ID NO: 3462 - DNA, 17 bp, Artificial Sequence
  IGHD1-1*01 Inverted
gtcgttccagttgtacc

SEQ ID NO: 3463 - DNA, 17 bp, Artificial Sequence
  IGHD1-7*01 Inverted
gtagttccagttatacc

SEQ ID NO: 3464 - DNA, 17 bp, Artificial Sequence
  IGHD1-14*01 Inverted
gtggttccggttatacc

SEQ ID NO: 3465 - DNA, 17 bp, Artificial Sequence
  IGHD1-20*01 Inverted
gtcgttccagttatacc

SEQ ID NO: 3466 - DNA, 20 bp, Artificial Sequence
  IGHD1-26*01 Inverted
gtagtagctcccactatacc

SEQ ID NO: 3467 - DNA, 31 bp, Artificial Sequence
  IGHD2-2*01 Inverted
ggcatagcagctggtactactacaatatcct

SEQ ID NO: 3468 - DNA, 31 bp, Artificial Sequence
  IGHD2-8*01 Inverted
ggtatagcatacaccattagtacaatatcct

SEQ ID NO: 3469 - DNA, 31 bp, Artificial Sequence
  IGHD2-15*01 Inverted
ggagtagcagctaccaccactacaatatcct

SEQ ID NO: 3470 - DNA, 28 bp, Artificial Sequence
  IGHD2-21*01 Inverted
ggaatagcaatcaccaccacaatatgct

SEQ ID NO: 3471 - DNA, 31 bp, Artificial Sequence
  IGHD3-3*01 Inverted
ggtataataaccactccaaaaatcgtaatac

SEQ ID NO: 3472 - DNA, 31 bp, Artificial Sequence
  IGHD3-9*01 Inverted
gttataataaccagtcaaaatatcgtaatac

SEQ ID NO: 3473 - DNA, 31 bp, Artificial Sequence
  IGHD3-10*01 Inverted
gttataataactccccgaaccatagtaatac

SEQ ID NO: 3474 - DNA, 37 bp, Artificial Sequence
  IGHD3-16*01 Inverted
ggtataagcataactcccccaaacgtaatcataatac

SEQ ID NO: 3475 - DNA, 31 bp, Artificial Sequence
  IGHD3-22*01 Inverted
gtagtaataaccactactatcatagtaatac

SEQ ID NO: 3476 - DNA, 16 bp, Artificial Sequence
  IGHD4-4*01  Inverted
gtagttactgtagtca

SEQ ID NO: 3477 - DNA, 16 bp, Artificial Sequence
  IGHD4-11*01  Inverted
gtagttactgtagtca

SEQ ID NO: 3478 - DNA, 16 bp, Artificial Sequence
  IGHD4-17*01  Inverted
gtagtcaccgtagtca

SEQ ID NO: 3479 - DNA, 19 bp, Artificial Sequence
  IGHD4-23*01  Inverted
ggagttaccaccgtagtca

SEQ ID NO: 3480 - DNA, 20 bp, Artificial Sequence
  IGHD5-5*01  Inverted
gtaaccatagctgtatccac

SEQ ID NO: 3481 - DNA, 23 bp, Artificial Sequence
  IGHD5-12*01 Inverted
gtaatcgtagccactatatccac

SEQ ID NO: 3482 - DNA, 20 bp, Artificial Sequence
  IGHD5-18*01 Inverted
gtaaccatagctgtatccac

SEQ ID NO: 3483 - DNA, 20 bp, Artificial Sequence
  IGHD5-24*01 Inverted
gtaattgtagccatctctac

SEQ ID NO: 3484 - DNA, 18 bp, Artificial Sequence
  IGHD6-6*01 Inverted
ggacgagctgctatactc

SEQ ID NO: 3485 - DNA, 21 bp, Artificial Sequence
  IGHD6-13*01 Inverted
gtaccagctgctgctataccc

SEQ ID NO: 3486 - DNA, 21 bp, Artificial Sequence
  IGHD6-19*01 Inverted
gtaccagccactgctataccc

SEQ ID NO: 3487 - DNA, 18 bp, Artificial Sequence
  IGHD6-25*01 Inverted
gtagccgctgctataccc

SEQ ID NO: 3488 - DNA, 11 bp, Artificial Sequence
  IGHD7-27*01 Inverted
tccccagttag

SEQ ID NO: 3489 - DNA, 24 bp, Artificial Sequence
  1_IGHD1-1*01_F
cgaaaggtacaactggaacgacgt

SEQ ID NO: 3490 - DNA, 24 bp, Artificial Sequence
  1_IGHD1-1*01_R
taggacgtcgttccagttgtacct

SEQ ID NO: 3491 - DNA, 24 bp, Artificial Sequence
  2_IGHD1-1*01_F
cgaaagtacaactggaacgacggt

SEQ ID NO: 3492 - DNA, 24 bp, Artificial Sequence
  2_IGHD1-1*01_R
taggaccgtcgttccagttgtact

SEQ ID NO: 3493 - DNA, 24 bp, Artificial Sequence
  3_IGHD1-1*01_F
cgaaagggtacaactggaacgact

SEQ ID NO: 3494 - DNA, 24 bp, Artificial Sequence
  3_IGHD1-1*01_R
taggagtcgttccagttgtaccct

SEQ ID NO: 3495 - DNA, 24 bp, Artificial Sequence
  1_IGHD1-7*01_F
cgaaaggtataactggaactacgt

SEQ ID NO: 3496 - DNA, 24 bp, Artificial Sequence
  1_IGHD1-7*01_R
taggacgtagttccagttatacct

SEQ ID NO: 3497 - DNA, 24 bp, Artificial Sequence
  3_IGHD1-7*01_F
cgaaagggtataactggaactact

SEQ ID NO: 3498 - DNA, 24 bp, Artificial Sequence
  3_IGHD1-7*01_R
taggagtagttccagttataccct

SEQ ID NO: 3499 - DNA, 24 bp, Artificial Sequence
  1_IGHD1-14*01_F
cgaaaggtataaccggaaccacgt

SEQ ID NO: 3500 - DNA, 24 bp, Artificial Sequence
  1_IGHD1-14*01_R
taggacgtggttccggttatacct

SEQ ID NO: 3501 - DNA, 24 bp, Artificial Sequence
  3_IGHD1-14*01_F
cgaaagggtataaccggaaccact

SEQ ID NO: 3502 - DNA, 24 bp, Artificial Sequence
  3_IGHD1-14*01_R
taggagtggttccggttataccct

SEQ ID NO: 3503 - DNA, 24 bp, Artificial Sequence
  1_IGHD1-20*01_F
cgaaaggtataactggaacgacgt

SEQ ID NO: 3504 - DNA, 24 bp, Artificial Sequence
  1_IGHD1-20*01_R
taggacgtcgttccagttatacct

SEQ ID NO: 3505 - DNA, 24 bp, Artificial Sequence
  3_IGHD1-20*01_F
cgaaagggtataactggaacgact

SEQ ID NO: 3506 - DNA, 24 bp, Artificial Sequence
  3_IGHD1-20*01_R
taggagtcgttccagttataccct

SEQ ID NO: 3507 - DNA, 27 bp, Artificial Sequence
  1_IGHD1-26*01_F
cgaaaggtatagtgggagctactacgt

SEQ ID NO: 3508 - DNA, 27 bp, Artificial Sequence
  1_IGHD1-26*01_R
taggacgtagtagctcccactatacct

SEQ ID NO: 3509 - DNA, 27 bp, Artificial Sequence
  3_IGHD1-26*01_F
cgaaagggtatagtgggagctactact

SEQ ID NO: 3510 - DNA, 27 bp, Artificial Sequence
  3_IGHD1-26*01_R
taggagtagtagctcccactataccct

SEQ ID NO: 3511 - DNA, 36 bp, Artificial Sequence
  2_IGHD2-2*01_F
cgaaaggatattgtagtagtaccagctgctatgcct

SEQ ID NO: 3512 - DNA, 36 bp, Artificial Sequence
  2_IGHD2-2*01_R
taggaggcatagcagctggtactactacaatatcct

SEQ ID NO: 3513 - DNA, 36 bp, Artificial Sequence
  3_IGHD2-2*01_F
cgaaagaggatattgtagtagtaccagctgctatgt

SEQ ID NO: 3514 - DNA, 36 bp, Artificial Sequence
  3_IGHD2-2*01_R
taggacatagcagctggtactactacaatatcctct

SEQ ID NO: 3515 - DNA, 36 bp, Artificial Sequence
  2_IGHD2-8*01_F
cgaaaggatattgtactaatggtgtatgctatacct

SEQ ID NO: 3516 - DNA, 36 bp, Artificial Sequence
  2_IGHD2-8*01_R
taggaggtatagcatacaccattagtacaatatcct

SEQ ID NO: 3517 - DNA, 36 bp, Artificial Sequence
  3_IGHD2-8*01_F
cgaaagaggatattgtactaatggtgtatgctatat

SEQ ID NO: 3518 - DNA, 36 bp, Artificial Sequence
  3_IGHD2-8*01_R
taggatatagcatacaccattagtacaatatcctct

SEQ ID NO: 3519 - DNA, 36 bp, Artificial Sequence
  2_IGHD2-15*01_F
cgaaaggatattgtagtggtggtagctgctactcct

SEQ ID NO: 3520 - DNA, 36 bp, Artificial Sequence
  2_IGHD2-15*01_R
taggaggagtagcagctaccaccactacaatatcct

SEQ ID NO: 3521 - DNA, 36 bp, Artificial Sequence
  3_IGHD2-15*01_F
cgaaagaggatattgtagtggtggtagctgctactt

SEQ ID NO: 3522 - DNA, 36 bp, Artificial Sequence
  3_IGHD2-15*01_R
taggaagtagcagctaccaccactacaatatcctct

SEQ ID NO: 3523 - DNA, 33 bp, Artificial Sequence
  2_IGHD2-21*01_F
cgaaagcatattgtggtggtgattgctattcct

SEQ ID NO: 3524 - DNA, 33 bp, Artificial Sequence
  2_IGHD2-21*01_R
taggaggaatagcaatcaccaccacaatatgct

SEQ ID NO: 3525 - DNA, 33 bp, Artificial Sequence
  3_IGHD2-21*01_F
cgaaagagcatattgtggtggtgattgctattt

SEQ ID NO: 3526 - DNA, 33 bp, Artificial Sequence
  3_IGHD2-21*01_R
taggaaatagcaatcaccaccacaatatgctct

SEQ ID NO: 3527 - DNA, 36 bp, Artificial Sequence
  1_IGHD3-3*01_F
cgaaagtattacgatttttggagtggttattatact

SEQ ID NO: 3528 - DNA, 36 bp, Artificial Sequence
  1_IGHD3-3*01_R
taggagtataataaccactccaaaaatcgtaatact

SEQ ID NO: 3529 - DNA, 36 bp, Artificial Sequence
  2_IGHD3-3*01_F
cgaaatattacgatttttggagtggttattatacct

SEQ ID NO: 3530 - DNA, 36 bp, Artificial Sequence
  2_IGHD3-3*01_R
taggaggtataataaccactccaaaaatcgtaatat

SEQ ID NO: 3531 - DNA, 36 bp, Artificial Sequence
  3_IGHD3-3*01_F
cgaaaggtattacgatttttggagtggttattatat

SEQ ID NO: 3532 - DNA, 36 bp, Artificial Sequence
  3_IGHD3-3*01_R
taggatataataaccactccaaaaatcgtaatacct

SEQ ID NO: 3533 - DNA, 36 bp, Artificial Sequence
  2_IGHD3-9*01_F
cgaaatattacgatattttgactggttattataact

SEQ ID NO: 3534 - DNA, 36 bp, Artificial Sequence
  2_IGHD3-9*01_R
taggagttataataaccagtcaaaatatcgtaatat

SEQ ID NO: 3535 - DNA, 36 bp, Artificial Sequence
  2_IGHD3-10*01_F
cgaaatattactatggttcggggagttattataact

SEQ ID NO: 3536 - DNA, 36 bp, Artificial Sequence
  2_IGHD3-10*01_R
taggagttataataactccccgaaccatagtaatat

SEQ ID NO: 3537 - DNA, 36 bp, Artificial Sequence
  3_IGHD3-10*01_F
cgaaaggtattactatggttcggggagttattatat

SEQ ID NO: 3538 - DNA, 36 bp, Artificial Sequence
  3_IGHD3-10*01_R
taggatataataactccccgaaccatagtaatacct

SEQ ID NO: 3539 - DNA, 42 bp, Artificial Sequence
  2_IGHD3-16*01_F
cgaaatattatgattacgtttgggggagttatgcttatacct

SEQ ID NO: 3540 - DNA, 42 bp, Artificial Sequence
  2_IGHD3-16*01_R
taggaggtataagcataactcccccaaacgtaatcataatat

SEQ ID NO: 3541 - DNA, 42 bp, Artificial Sequence
  3_IGHD3-16*01_F
cgaaaggtattatgattacgtttgggggagttatgcttatat

SEQ ID NO: 3542 - DNA, 42 bp, Artificial Sequence
  3_IGHD3-16*01_R
taggatataagcataactcccccaaacgtaatcataatacct

SEQ ID NO: 3543 - DNA, 36 bp, Artificial Sequence
  2_IGHD3-22*01_F
cgaaatattactatgatagtagtggttattactact

SEQ ID NO: 3544 - DNA, 36 bp, Artificial Sequence
  2_IGHD3-22*01_R
taggagtagtaataaccactactatcatagtaatat

SEQ ID NO: 3545 - DNA, 36 bp, Artificial Sequence
  3_IGHD3-22*01_F
cgaaaggtattactatgatagtagtggttattactt

SEQ ID NO: 3546 - DNA, 36 bp, Artificial Sequence
  3_IGHD3-22*01_R
taggaagtaataaccactactatcatagtaatacct

SEQ ID NO: 3547 - DNA, 21 bp, Artificial Sequence
  2_IGHD4-4*01 (1) _F
cgaaagactacagtaactact

SEQ ID NO: 3548 - DNA, 21 bp, Artificial Sequence
  2_IGHD4-4*01 (1) _R
taggagtagttactgtagtct

SEQ ID NO: 3549 - DNA, 21 bp, Artificial Sequence
  3_IGHD4-4*01 (1) _F
cgaaagtgactacagtaactt

SEQ ID NO: 3550 - DNA, 21 bp, Artificial Sequence
  3_IGHD4-4*01 (1) _R
taggaagttactgtagtcact

SEQ ID NO: 3551 - DNA, 21 bp, Artificial Sequence
  2_IGHD4-11*01 (1) _F
cgaaagactacagtaactact

SEQ ID NO: 3552 - DNA, 21 bp, Artificial Sequence
  2_IGHD4-11*01 (1) _R
taggagtagttactgtagtct

SEQ ID NO: 3553 - DNA, 21 bp, Artificial Sequence
  3_IGHD4-11*01 (1) _F
cgaaagtgactacagtaactt

SEQ ID NO: 3554 - DNA, 21 bp, Artificial Sequence
  3_IGHD4-11*01 (1) _R
taggaagttactgtagtcact

SEQ ID NO: 3555 - DNA, 21 bp, Artificial Sequence
  2_IGHD4-17*01_F
cgaaagactacggtgactact

SEQ ID NO: 3556 - DNA, 21 bp, Artificial Sequence
  2_IGHD4-17*01_R
taggagtagtcaccgtagtct

SEQ ID NO: 3557 - DNA, 21 bp, Artificial Sequence
  3_IGHD4-17*01_F
cgaaagtgactacggtgactt

SEQ ID NO: 3558 - DNA, 21 bp, Artificial Sequence
  3_IGHD4-17*01_R
taggaagtcaccgtagtcact

SEQ ID NO: 3559 - DNA, 24 bp, Artificial Sequence
  2_IGHD4-23*01_F
cgaaagactacggtggtaactcct

SEQ ID NO: 3560 - DNA, 24 bp, Artificial Sequence
  2_IGHD4-23*01_R
taggaggagttaccaccgtagtct

SEQ ID NO: 3561 - DNA, 24 bp, Artificial Sequence
  3_IGHD4-23*01_F
cgaaagtgactacggtggtaactt

SEQ ID NO: 3562 - DNA, 24 bp, Artificial Sequence
  3_IGHD4-23*01_R
taggaagttaccaccgtagtcact

SEQ ID NO: 3563 - DNA, 27 bp, Artificial Sequence
  1_IGHD5-5*01 (2) _F
cgaaagtggatacagctatggttacgt

SEQ ID NO: 3564 - DNA, 27 bp, Artificial Sequence
  1_IGHD5-5*01 (2) _R
taggacgtaaccatagctgtatccact

SEQ ID NO: 3565 - DNA, 27 bp, Artificial Sequence
  2_IGHD5-5*01 (2) _F
cgaaatggatacagctatggttacggt

SEQ ID NO: 3566 - DNA, 27 bp, Artificial Sequence
  2_IGHD5-5*01 (2) _R
taggaccgtaaccatagctgtatccat

SEQ ID NO: 3567 - DNA, 27 bp, Artificial Sequence
  3_IGHD5-5*01 (2) _F
cgaaaggtggatacagctatggttact

SEQ ID NO: 3568 - DNA, 27 bp, Artificial Sequence
  3_IGHD5-5*01 (2) _R
taggagtaaccatagctgtatccacct

SEQ ID NO: 3569 - DNA, 30 bp, Artificial Sequence
  1_IGHD5-12*01_F
cgaaagtggatatagtggctacgattacgt

SEQ ID NO: 3570 - DNA, 30 bp, Artificial Sequence
  1_IGHD5-12*01_R
taggacgtaatcgtagccactatatccact

SEQ ID NO: 3571 - DNA, 30 bp, Artificial Sequence
  3_IGHD5-12*01_F
cgaaaggtggatatagtggctacgattact

SEQ ID NO: 3572 - DNA, 30 bp, Artificial Sequence
  3_IGHD5-12*01_R
taggagtaatcgtagccactatatccacct

SEQ ID NO: 3573 - DNA, 27 bp, Artificial Sequence
  1_IGHD5-18*01 (2) _F
cgaaagtggatacagctatggttacgt

SEQ ID NO: 3574 - DNA, 27 bp, Artificial Sequence
  1_IGHD5-18*01 (2) _R
taggacgtaaccatagctgtatccact

SEQ ID NO: 3575 - DNA, 27 bp, Artificial Sequence
  2_IGHD5-18*01 (2) _F
cgaaatggatacagctatggttacggt

SEQ ID NO: 3576 - DNA, 27 bp, Artificial Sequence
  2_IGHD5-18*01 (2) _R
taggaccgtaaccatagctgtatccat

SEQ ID NO: 3577 - DNA, 27 bp, Artificial Sequence
  3_IGHD5-18*01 (2) _F
cgaaaggtggatacagctatggttact

SEQ ID NO: 3578 - DNA, 27 bp, Artificial Sequence
  3_IGHD5-18*01 (2) _R
taggagtaaccatagctgtatccacct

SEQ ID NO: 3579 - DNA, 27 bp, Artificial Sequence
  1_IGHD5-24*01_F
cgaaagtagagatggctacaattacgt

SEQ ID NO: 3580 - DNA, 27 bp, Artificial Sequence
  1_IGHD5-24*01_R
taggacgtaattgtagccatctctact

SEQ ID NO: 3581 - DNA, 27 bp, Artificial Sequence
  3_IGHD5-24*01_F
cgaaaggtagagatggctacaattact

SEQ ID NO: 3582 - DNA, 27 bp, Artificial Sequence
  3_IGHD5-24*01_R
taggagtaattgtagccatctctacct

SEQ ID NO: 3583 - DNA, 24 bp, Artificial Sequence
  1_IGHD6-6*01_F
cgaaagagtatagcagctcgtcct

SEQ ID NO: 3584 - DNA, 24 bp, Artificial Sequence
  1_IGHD6-6*01_R
taggaggacgagctgctatactct

SEQ ID NO: 3585 - DNA, 24 bp, Artificial Sequence
  2_IGHD6-6*01_F
cgaaaagtatagcagctcgtccgt

SEQ ID NO: 3586 - DNA, 24 bp, Artificial Sequence
  2_IGHD6-6*01_R
taggacggacgagctgctatactt

SEQ ID NO: 3587 - DNA, 27 bp, Artificial Sequence
  1_IGHD6-13*01_F
cgaaagggtatagcagcagctggtact

SEQ ID NO: 3588 - DNA, 27 bp, Artificial Sequence
  1_IGHD6-13*01_R
taggagtaccagctgctgctataccct

SEQ ID NO: 3589 - DNA, 27 bp, Artificial Sequence
  2_IGHD6-13*01_F
cgaaaggtatagcagcagctggtacgt

SEQ ID NO: 3590 - DNA, 27 bp, Artificial Sequence
  2_IGHD6-13*01_R
taggacgtaccagctgctgctatacct

SEQ ID NO: 3591 - DNA, 27 bp, Artificial Sequence
  1_IGHD6-19*01_F
cgaaagggtatagcagtggctggtact

SEQ ID NO: 3592 - DNA, 27 bp, Artificial Sequence
  1_IGHD6-19*01_R
taggagtaccagccactgctataccct

SEQ ID NO: 3593 - DNA, 27 bp, Artificial Sequence
  2_IGHD6-19*01_F
cgaaaggtatagcagtggctggtacgt

SEQ ID NO: 3594 - DNA, 27 bp, Artificial Sequence
  2_IGHD6-19*01_R
taggacgtaccagccactgctatacct

SEQ ID NO: 3595 - DNA, 24 bp, Artificial Sequence
  1_IGHD6-25*01_F
cgaaagggtatagcagcggctact

SEQ ID NO: 3596 - DNA, 24 bp, Artificial Sequence
  1_IGHD6-25*01_R
taggagtagccgctgctataccct

SEQ ID NO: 3597 - DNA, 24 bp, Artificial Sequence
  2_IGHD6-25*01_F
cgaaaggtatagcagcggctacgt

SEQ ID NO: 3598 - DNA, 24 bp, Artificial Sequence
  2_IGHD6-25*01_R
taggacgtagccgctgctatacct

SEQ ID NO: 3599 - DNA, 18 bp, Artificial Sequence
  1_IGHD7-27*01_F
cgaaactaactggggagt

SEQ ID NO: 3600 - DNA, 18 bp, Artificial Sequence
  1_IGHD7-27*01_R
taggactccccagttagt

SEQ ID NO: 3601 - DNA, 18 bp, Artificial Sequence
  3_IGHD7-27*01_F
cgaaagctaactggggat

SEQ ID NO: 3602 - DNA, 18 bp, Artificial Sequence
  3_IGHD7-27*01_R
taggatccccagttagct

SEQ ID NO: 3603 - DNA, 24 bp, Artificial Sequence
  1'_IGHD1-1*01_F
cgaaagtcgttccagttgtaccgt

SEQ ID NO: 3604 - DNA, 24 bp, Artificial Sequence
  1'_IGHD1-1*01_R
taggacggtacaactggaacgact

SEQ ID NO: 3605 - DNA, 24 bp, Artificial Sequence
  2'_IGHD1-1*01_F
cgaaatcgttccagttgtaccggt

SEQ ID NO: 3606 - DNA, 24 bp, Artificial Sequence
  2'_IGHD1-1*01_R
taggaccggtacaactggaacgat

SEQ ID NO: 3607 - DNA, 24 bp, Artificial Sequence
  3'_IGHD1-1*01_F
cgaaaggtcgttccagttgtacct

SEQ ID NO: 3608 - DNA, 24 bp, Artificial Sequence
  3'_IGHD1-1*01_R
taggaggtacaactggaacgacct

SEQ ID NO: 3609 - DNA, 24 bp, Artificial Sequence
  1'_IGHD1-7*01_F
cgaaagtagttccagttataccgt

SEQ ID NO: 3610 - DNA, 24 bp, Artificial Sequence
  1'_IGHD1-7*01_R
taggacggtataactggaactact

SEQ ID NO: 3611 - DNA, 24 bp, Artificial Sequence
  3'_IGHD1-7*01_F
cgaaaggtagttccagttatacct

SEQ ID NO: 3612 - DNA, 24 bp, Artificial Sequence
  3'_IGHD1-7*01_R
taggaggtataactggaactacct

SEQ ID NO: 3613 - DNA, 24 bp, Artificial Sequence
  1'_IGHD1-14*01_F
cgaaagtggttccggttataccgt

SEQ ID NO: 3614 - DNA, 24 bp, Artificial Sequence
  1'_IGHD1-14*01_R
taggacggtataaccggaaccact

SEQ ID NO: 3615 - DNA, 24 bp, Artificial Sequence
  2'_IGHD1-14*01_F
cgaaatggttccggttataccggt

SEQ ID NO: 3616 - DNA, 24 bp, Artificial Sequence
  2'_IGHD1-14*01_R
taggaccggtataaccggaaccat

SEQ ID NO: 3617 - DNA, 24 bp, Artificial Sequence
  3'_IGHD1-14*01_F
cgaaaggtggttccggttatacct

SEQ ID NO: 3618 - DNA, 24 bp, Artificial Sequence
  3'_IGHD1-14*01_R
taggaggtataaccggaaccacct

SEQ ID NO: 3619 - DNA, 24 bp, Artificial Sequence
  1'_IGHD1-20*01_F
cgaaagtcgttccagttataccgt

SEQ ID NO: 3620 - DNA, 24 bp, Artificial Sequence
  1'_IGHD1-20*01_R
taggacggtataactggaacgact

SEQ ID NO: 3621 - DNA, 24 bp, Artificial Sequence
  2'_IGHD1-20*01_F
cgaaatcgttccagttataccggt

SEQ ID NO: 3622 - DNA, 24 bp, Artificial Sequence
  2'_IGHD1-20*01_R
taggaccggtataactggaacgat

SEQ ID NO: 3623 - DNA, 24 bp, Artificial Sequence
  3'_IGHD1-20*01_F
cgaaaggtcgttccagttatacct

SEQ ID NO: 3624 - DNA, 24 bp, Artificial Sequence
  3'_IGHD1-20*01_R
taggaggtataactggaacgacct

SEQ ID NO: 3625 - DNA, 27 bp, Artificial Sequence
  1'_IGHD1-26*01_F
cgaaagtagtagctcccactataccgt

SEQ ID NO: 3626 - DNA, 27 bp, Artificial Sequence
  1'_IGHD1-26*01_R
taggacggtatagtgggagctactact

SEQ ID NO: 3627 - DNA, 27 bp, Artificial Sequence
  3'_IGHD1-26*01_F
cgaaaggtagtagctcccactatacct

SEQ ID NO: 3628 - DNA, 27 bp, Artificial Sequence
  3'_IGHD1-26*01_R
taggaggtatagtgggagctactacct

SEQ ID NO: 3629 - DNA, 36 bp, Artificial Sequence
  1'_IGHD2-2*01_F
cgaaaggcatagcagctggtactactacaatatcct

SEQ ID NO: 3630 - DNA, 36 bp, Artificial Sequence
  1'_IGHD2-2*01_R
taggaggatattgtagtagtaccagctgctatgcct

SEQ ID NO: 3631 - DNA, 36 bp, Artificial Sequence
  3'_IGHD2-2*01_F
cgaaagggcatagcagctggtactactacaatatct

SEQ ID NO: 3632 - DNA, 36 bp, Artificial Sequence
  3'_IGHD2-2*01_R
taggagatattgtagtagtaccagctgctatgccct

SEQ ID NO: 3633 - DNA, 36 bp, Artificial Sequence
  1'_IGHD2-8*01_F
cgaaaggtatagcatacaccattagtacaatatcct

SEQ ID NO: 3634 - DNA, 36 bp, Artificial Sequence
  1'_IGHD2-8*01_R
taggaggatattgtactaatggtgtatgctatacct

SEQ ID NO: 3635 - DNA, 36 bp, Artificial Sequence
  1'_IGHD2-15*01_F
cgaaaggagtagcagctaccaccactacaatatcct

SEQ ID NO: 3636 - DNA, 36 bp, Artificial Sequence
  1'_IGHD2-15*01_R
taggaggatattgtagtggtggtagctgctactcct

SEQ ID NO: 3637 - DNA, 36 bp, Artificial Sequence
  3'_IGHD2-15*01_F
cgaaagggagtagcagctaccaccactacaatatct

SEQ ID NO: 3638 - DNA, 36 bp, Artificial Sequence
  3'_IGHD2-15*01_R
taggagatattgtagtggtggtagctgctactccct

SEQ ID NO: 3639 - DNA, 33 bp, Artificial Sequence
  1'_IGHD2-21*01_F
cgaaaggaatagcaatcaccaccacaatatgct

SEQ ID NO: 3640 - DNA, 33 bp, Artificial Sequence
  1'_IGHD2-21*01_R
taggagcatattgtggtggtgattgctattcct

SEQ ID NO: 3641 - DNA, 33 bp, Artificial Sequence
  3'_IGHD2-21*01_F
cgaaagggaatagcaatcaccaccacaatatgt

SEQ ID NO: 3642 - DNA, 33 bp, Artificial Sequence
  3'_IGHD2-21*01_R
taggacatattgtggtggtgattgctattccct

SEQ ID NO: 3643 - DNA, 36 bp, Artificial Sequence
  1'_IGHD3-3*01_F
cgaaaggtataataaccactccaaaaatcgtaatat

SEQ ID NO: 3644 - DNA, 36 bp, Artificial Sequence
  1'_IGHD3-3*01_R
taggatattacgatttttggagtggttattatacct

SEQ ID NO: 3645 - DNA, 36 bp, Artificial Sequence
  3'_IGHD3-3*01_F
cgaaagggtataataaccactccaaaaatcgtaatt

SEQ ID NO: 3646 - DNA, 36 bp, Artificial Sequence
  3'_IGHD3-3*01_R
taggaattacgatttttggagtggttattataccct

SEQ ID NO: 3647 - DNA, 36 bp, Artificial Sequence
  1'_IGHD3-9*01_F
cgaaagttataataaccagtcaaaatatcgtaatat

SEQ ID NO: 3648 - DNA, 36 bp, Artificial Sequence
  1'_IGHD3-9*01_R
taggatattacgatattttgactggttattataact

SEQ ID NO: 3649 - DNA, 36 bp, Artificial Sequence
  3'_IGHD3-9*01_F
cgaaaggttataataaccagtcaaaatatcgtaatt

SEQ ID NO: 3650 - DNA, 36 bp, Artificial Sequence
  3'_IGHD3-9*01_R
taggaattacgatattttgactggttattataacct

SEQ ID NO: 3651 - DNA, 36 bp, Artificial Sequence
  1'_IGHD3-10*01_F
cgaaagttataataactccccgaaccatagtaatat

SEQ ID NO: 3652 - DNA, 36 bp, Artificial Sequence
  1'_IGHD3-10*01_R
taggatattactatggttcggggagttattataact

SEQ ID NO: 3653 - DNA, 36 bp, Artificial Sequence
  3'_IGHD3-10*01_F
cgaaaggttataataactccccgaaccatagtaatt

SEQ ID NO: 3654 - DNA, 36 bp, Artificial Sequence
  3'_IGHD3-10*01_R
taggaattactatggttcggggagttattataacct

SEQ ID NO: 3655 - DNA, 42 bp, Artificial Sequence
  1'_IGHD3-16*01_F
cgaaaggtataagcataactcccccaaacgtaatcataatat

SEQ ID NO: 3656 - DNA, 42 bp, Artificial Sequence
  1'_IGHD3-16*01_R
taggatattatgattacgtttgggggagttatgcttatacct

SEQ ID NO: 3657 - DNA, 42 bp, Artificial Sequence
  3'_IGHD3-16*01_F
cgaaagggtataagcataactcccccaaacgtaatcataatt

SEQ ID NO: 3658 - DNA, 42 bp, Artificial Sequence
  3'_IGHD3-16*01_R
taggaattatgattacgtttgggggagttatgcttataccct

SEQ ID NO: 3659 - DNA, 36 bp, Artificial Sequence
  1'_IGHD3-22*01_F
cgaaagtagtaataaccactactatcatagtaatat

SEQ ID NO: 3660 - DNA, 36 bp, Artificial Sequence
  1'_IGHD3-22*01_R
taggatattactatgatagtagtggttattactact

SEQ ID NO: 3661 - DNA, 21 bp, Artificial Sequence
  1'_IGHD4-4*01 (1) _F
cgaaagtagttactgtagtct

SEQ ID NO: 3662 - DNA, 21 bp, Artificial Sequence
  1'_IGHD4-4*01 (1) _R
taggagactacagtaactact

SEQ ID NO: 3663 - DNA, 21 bp, Artificial Sequence
  3'_IGHD4-4*01 (1) _F
cgaaaggtagttactgtagtt

SEQ ID NO: 3664 - DNA, 21 bp, Artificial Sequence
  3'_IGHD4-4*01 (1) _R
taggaactacagtaactacct

SEQ ID NO: 3665 - DNA, 21 bp, Artificial Sequence
  1'_IGHD4-11*01 (1) _F
cgaaagtagttactgtagtct

SEQ ID NO: 3666 - DNA, 21 bp, Artificial Sequence
  1'_IGHD4-11*01 (1) _R
taggagactacagtaactact

SEQ ID NO: 3667 - DNA, 21 bp, Artificial Sequence
  3'_IGHD4-11*01 (1) _F
cgaaaggtagttactgtagtt

SEQ ID NO: 3668 - DNA, 21 bp, Artificial Sequence
  3'_IGHD4-11*01 (1) _R
taggaactacagtaactacct

SEQ ID NO: 3669 - DNA, 21 bp, Artificial Sequence
  1'_IGHD4-17*01_F
cgaaagtagtcaccgtagtct

SEQ ID NO: 3670 - DNA, 21 bp, Artificial Sequence
  1'_IGHD4-17*01_R
taggagactacggtgactact

SEQ ID NO: 3671 - DNA, 21 bp, Artificial Sequence
  3'_IGHD4-17*01_F
cgaaaggtagtcaccgtagtt

SEQ ID NO: 3672 - DNA, 21 bp, Artificial Sequence
  3'_IGHD4-17*01_R
taggaactacggtgactacct

SEQ ID NO: 3673 - DNA, 24 bp, Artificial Sequence
  1'_IGHD4-23*01_F
cgaaaggagttaccaccgtagtct

SEQ ID NO: 3674 - DNA, 24 bp, Artificial Sequence
  1'_IGHD4-23*01_R
taggagactacggtggtaactcct

SEQ ID NO: 3675 - DNA, 24 bp, Artificial Sequence
  3'_IGHD4-23*01_F
cgaaagggagttaccaccgtagtt

SEQ ID NO: 3676 - DNA, 24 bp, Artificial Sequence
  3'_IGHD4-23*01_R
taggaactacggtggtaactccct

SEQ ID NO: 3677 - DNA, 27 bp, Artificial Sequence
  1'_IGHD5-5*01 (2) _F
cgaaagtaaccatagctgtatccacgt

SEQ ID NO: 3678 - DNA, 27 bp, Artificial Sequence
  1'_IGHD5-5*01 (2) _R
taggacgtggatacagctatggttact

SEQ ID NO: 3679 - DNA, 27 bp, Artificial Sequence
  3'_IGHD5-5*01 (2) _F
cgaaaggtaaccatagctgtatccact

SEQ ID NO: 3680 - DNA, 27 bp, Artificial Sequence
  3'_IGHD5-5*01 (2) _R
taggagtggatacagctatggttacct

SEQ ID NO: 3681 - DNA, 30 bp, Artificial Sequence
  1'_IGHD5-12*01_F
cgaaagtaatcgtagccactatatccacgt

SEQ ID NO: 3682 - DNA, 30 bp, Artificial Sequence
  1'_IGHD5-12*01_R
taggacgtggatatagtggctacgattact

SEQ ID NO: 3683 - DNA, 30 bp, Artificial Sequence
  3'_IGHD5-12*01_F
cgaaaggtaatcgtagccactatatccact

SEQ ID NO: 3684 - DNA, 30 bp, Artificial Sequence
  3'_IGHD5-12*01_R
taggagtggatatagtggctacgattacct

SEQ ID NO: 3685 - DNA, 27 bp, Artificial Sequence
  1'_IGHD5-18*01 (2) _F
cgaaagtaaccatagctgtatccacgt

SEQ ID NO: 3686 - DNA, 27 bp, Artificial Sequence
  1'_IGHD5-18*01 (2) _R
taggacgtggatacagctatggttact

SEQ ID NO: 3687 - DNA, 27 bp, Artificial Sequence
  3'_IGHD5-18*01 (2) _F
cgaaaggtaaccatagctgtatccact

SEQ ID NO: 3688 - DNA, 27 bp, Artificial Sequence
  3'_IGHD5-18*01 (2) _R
taggagtggatacagctatggttacct

SEQ ID NO: 3689 - DNA, 27 bp, Artificial Sequence
  1'_IGHD5-24*01_F
cgaaagtaattgtagccatctctacgt

SEQ ID NO: 3690 - DNA, 27 bp, Artificial Sequence
  1'_IGHD5-24*01_R
taggacgtagagatggctacaattact

SEQ ID NO: 3691 - DNA, 27 bp, Artificial Sequence
  3'_IGHD5-24*01_F
cgaaaggtaattgtagccatctctact

SEQ ID NO: 3692 - DNA, 27 bp, Artificial Sequence
  3'_IGHD5-24*01_R
taggagtagagatggctacaattacct

SEQ ID NO: 3693 - DNA, 24 bp, Artificial Sequence
  1'_IGHD6-6*01_F
cgaaaggacgagctgctatactct

SEQ ID NO: 3694 - DNA, 24 bp, Artificial Sequence
  1'_IGHD6-6*01_R
taggagagtatagcagctcgtcct

SEQ ID NO: 3695 - DNA, 24 bp, Artificial Sequence
  2'_IGHD6-6*01_F
cgaaagacgagctgctatactcgt

SEQ ID NO: 3696 - DNA, 24 bp, Artificial Sequence
  2'_IGHD6-6*01_R
taggacgagtatagcagctcgtct

SEQ ID NO: 3697 - DNA, 24 bp, Artificial Sequence
  3'_IGHD6-6*01_F
cgaaagggacgagctgctatactt

SEQ ID NO: 3698 - DNA, 24 bp, Artificial Sequence
  3'_IGHD6-6*01_R
taggaagtatagcagctcgtccct

SEQ ID NO: 3699 - DNA, 27 bp, Artificial Sequence
  1'_IGHD6-13*01_F
cgaaagtaccagctgctgctataccct

SEQ ID NO: 3700 - DNA, 27 bp, Artificial Sequence
  1'_IGHD6-13*01_R
taggagggtatagcagcagctggtact

SEQ ID NO: 3701 - DNA, 27 bp, Artificial Sequence
  2'_IGHD6-13*01_F
cgaaataccagctgctgctatacccgt

SEQ ID NO: 3702 - DNA, 27 bp, Artificial Sequence
  2'_IGHD6-13*01_R
taggacgggtatagcagcagctggtat

SEQ ID NO: 3703 - DNA, 27 bp, Artificial Sequence
  3'_IGHD6-13*01_F
cgaaaggtaccagctgctgctatacct

SEQ ID NO: 3704 - DNA, 27 bp, Artificial Sequence
  3'_IGHD6-13*01_R
taggaggtatagcagcagctggtacct

SEQ ID NO: 3705 - DNA, 27 bp, Artificial Sequence
  1'_IGHD6-19*01_F
cgaaagtaccagccactgctataccct

SEQ ID NO: 3706 - DNA, 27 bp, Artificial Sequence
  1'_IGHD6-19*01_R
taggagggtatagcagtggctggtact

SEQ ID NO: 3707 - DNA, 27 bp, Artificial Sequence
  2'_IGHD6-19*01_F
cgaaataccagccactgctatacccgt

SEQ ID NO: 3708 - DNA, 27 bp, Artificial Sequence
  2'_IGHD6-19*01_R
taggacgggtatagcagtggctggtat

SEQ ID NO: 3709 - DNA, 27 bp, Artificial Sequence
  3'_IGHD6-19*01_F
cgaaaggtaccagccactgctatacct

SEQ ID NO: 3710 - DNA, 27 bp, Artificial Sequence
  3'_IGHD6-19*01_R
taggaggtatagcagtggctggtacct

SEQ ID NO: 3711 - DNA, 24 bp, Artificial Sequence
  1'_IGHD6-25*01_F
cgaaagtagccgctgctataccct

SEQ ID NO: 3712 - DNA, 24 bp, Artificial Sequence
  1'_IGHD6-25*01_R
taggagggtatagcagcggctact

SEQ ID NO: 3713 - DNA, 24 bp, Artificial Sequence
  3'_IGHD6-25*01_F
cgaaaggtagccgctgctatacct

SEQ ID NO: 3714 - DNA, 24 bp, Artificial Sequence
  3'_IGHD6-25*01_R
taggaggtatagcagcggctacct

SEQ ID NO: 3715 - DNA, 18 bp, Artificial Sequence
  1'_IGHD7-27*01_F
cgaaatccccagttaggt

SEQ ID NO: 3716 - DNA, 18 bp, Artificial Sequence
  1'_IGHD7-27*01_R
taggacctaactggggat

SEQ ID NO: 3717 - DNA, 18 bp, Artificial Sequence
  2'_IGHD7-27*01_F
cgaaaccccagttagggt

SEQ ID NO: 3718 - DNA, 18 bp, Artificial Sequence
  2'_IGHD7-27*01_R
taggaccctaactggggt

SEQ ID NO: 3719 - DNA, 7 bp, Artificial Sequence
  BsaI Restriction Site
  variation 7: n = a, c, t, or g
ggtctcn

SEQ ID NO: 3720 - protein, 123 aa, Artificial Sequence
  VH5-51_IGHD5-18*01>3_IGHJ4*01_G100K
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRKYSYGYDYFDYWGQGTLVTVSSAS

SEQ ID NO: 3721 - protein, 123 aa, Artificial Sequence
  VH5-51_IGHD5-18*01>3_IGHJ4*01_G100R
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRRYSYGYDYFDYWGQGTLVTVSSAS

SEQ ID NO: 3722 - protein, 124 aa, Artificial Sequence
  VH1-46_IGHD6-6*01>1_IGHJ1*01_S104F
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSFSAEYFQHWGQGTLVTVSSAS

SEQ ID NO: 3723 - protein, 124 aa, Artificial Sequence
  VH1-46_IGHD6-6*01_IGHJ1*01_S104A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSASAEYFQHWGQGTLVTVSSAS

SEQ ID NO: 3724 - protein, 123 aa, Artificial Sequence
  VH5-51_IGHD5-18*01>3_IGHJ4*01_G104T
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYTYDYFDYWGQGTLVTVSSAS

SEQ ID NO: 3725 - protein, 124 aa, Artificial Sequence
  VH1-46_IGHD6-6*01_IGHJ1*01_S103P
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSPSSAEYFQHWGQGTLVTVSSAS

SEQ ID NO: 3726 - protein, 124 aa, Artificial Sequence
  VH1-46_IGHD6-6*01_IGHJ1*01_S102A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYASSSAEYFQHWGQGTLVTVSSAS

SEQ ID NO: 3727 - protein, 124 aa, Artificial Sequence
  VH1-46_IGHD6-6*01_IGHJ1*01_S102A_S103P_S104F
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSAEYFQHWGQGTLVTVSSAS

SEQ ID NO: 3728 - protein, 123 aa, Artificial Sequence
  VH5-51_IGHD5-18*01>3_IGHJ4*01_G100K_G104T
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 3729 - protein, 124 aa, Artificial Sequence
  VH1-46_IGHD6-6*01_IGHJ1*01_S102A_S103P_S104F_H111F
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSAEYFQFWGQGTLVTVSSAS

SEQ ID NO: 3730 - protein, 124 aa, Artificial Sequence
  VH1-46_IGHD6-6*01_IGHJ1*01_S102A_S103P_S104F_H111Y
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSAEYFQYWGQGTLVTVSSAS

SEQ ID NO: 3731 - protein, 124 aa, Artificial Sequence
  VH1-46_IGHD6-6*01_IGHJ1*01_S102A_S103P_S104Y_H111Y
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPYSAEYFQYWGQGTLVTVSSAS

SEQ ID NO: 3732 - protein, 110 aa, Artificial Sequence
  L6_IGKJ1*01_S28P
EIVLTQSPATLSLSPGERATLSCRASQPVSSYLAWYQQKPGQAPRLLIYDASNRATGIPARFSGSGSGTDFTLTISSLEPEDFAVYYCQQRSNWPPWTFGQGTKVEIKRT

SEQ ID NO: 3733 - protein, 110 aa, Artificial Sequence
  L6_IGKJ1*01_S30N
EIVLTQSPATLSLSPGERATLSCRASQSVNSYLAWYQQKPGQAPRLLIYDASNRATGIPARFSGSGSGTDFTLTISSLEPEDFAVYYCQQRSNWPPWTFGQGTKVEIKRT

SEQ ID NO: 3734 - protein, 110 aa, Artificial Sequence
  L6_IGKJ1*01_S31K
EIVLTQSPATLSLSPGERATLSCRASQSVSKYLAWYQQKPGQAPRLLIYDASNRATGIPARFSGSGSGTDFTLTISSLEPEDFAVYYCQQRSNWPPWTFGQGTKVEIKRT

SEQ ID NO: 3735 - protein, 16 aa, Artificial Sequence
  EMP 16 peptide
TYSCHFGPLTWVCKPQ

SEQ ID NO: 3736 - protein, 6 aa, Homo sapiens
  IGHD5-18*01
GYSYGY

SEQ ID NO: 3737 - protein, 6 aa, Homo sapiens
  IGHD6-6*01
EYSSSS

SEQ ID NO: 3738 - protein, 17 aa, Homo sapiens
  IGHJ1*01
AEYFQHWGQGTLVTVSS

SEQ ID NO: 3739 - protein, 95 aa, Homo sapiens
  IGKV3-11*01
EIVLTQSPATLSLSPGERATLSCRASQSVSSYLAWYQQKPGQAPRLLIYDASNRATGIPARFSGSGSGTDFTLTISSLEPEDFAVYYCQQRSNWP

SEQ ID NO: 3740 - protein, 95 aa, Homo sapiens
  IGKV3-11*02
EIVLTQSPATLSLSPGERATLSCRASQSVSSYLAWYQQKPGQAPRLLIYDASNRATGIPARFSGSGSGRDFTLTISSLEPEDFAVYYCQQRSNWP

SEQ ID NO: 3741 - DNA, 369 bp, Artificial Sequence
  VH5-51_IGHD5-18*01>3_IGHJ4*01_G100K
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacgtaagtacagctatggttacgactactttgactactggggccaaggaaccctggtcaccgtctcctcagctagc

SEQ ID NO: 3742 - DNA, 369 bp, Artificial Sequence
  VH5-51_IGHD5-18*01>3_IGHJ4*01_G100R
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacgtaggtacagctatggttacgactactttgactactggggccaaggaaccctggtcaccgtctcctcagctagc

SEQ ID NO: 3743 - DNA, 372 bp, Artificial Sequence
  VH1-46_IGHD6-6*01>1_IGHJ1*01_S104F
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggagtatagcagcttctccgctgaatacttccagcactggggccagggcaccctggtcaccgtctcctcagctagc

SEQ ID NO: 3744 - DNA, 372 bp, Artificial Sequence
  VH1-46_IGHD6-6*01_IGHJ1*01_S104A
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggagtatagcagcgcgtccgctgaatacttccagcactggggccagggcaccctggtcaccgtctcctcagctagc

SEQ ID NO: 3745 - DNA, 369 bp, Artificial Sequence
  VH5-51_IGHD5-18*01>3_IGHJ4*01_G104T
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacgtggatacagctatacttacgactactttgactactggggccaaggaaccctggtcaccgtctcctcagctagc

SEQ ID NO: 3746 - DNA, 372 bp, Artificial Sequence
  VH1-46_IGHD6-6*01_IGHJ1*01_S103P
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggagtatagcccgtcgtccgctgaatacttccagcactggggccagggcaccctggtcaccgtctcctcagctagc

SEQ ID NO: 3747 - DNA, 372 bp, Artificial Sequence
  VH1-46_IGHD6-6*01_IGHJ1*01_S102A
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggagtatgccagctcgtccgctgaatacttccagcactggggccagggcaccctggtcaccgtctcctcagctagc

SEQ ID NO: 3748 - DNA, 372 bp, Artificial Sequence
  VH1-46_IGHD6-6*01_IGHJ1*01_S102A_S103P_S104F
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggagtatgcgccgttctccgctgaatacttccagcactggggccagggcaccctggtcaccgtctcctcagctagc

SEQ ID NO: 3749 - DNA, 369 bp, Artificial Sequence
  VH5-51_IGHD5-18*01>3_IGHJ4*01_G100K_G104T
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacgtaagtacagctatacctacgactactttgactactggggccaaggaaccctggtcaccgtctcctcagctagc

SEQ ID NO: 3750 - DNA, 372 bp, Artificial Sequence
  VH1-46_IGHD6-6*01_IGHJ1*01_S102A_S103P_S104F_H111F
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggagtatgcgccgttctccgctgaatacttccagttctggggccagggcaccctggtcaccgtctcctcagctagc

SEQ ID NO: 3751 - DNA, 372 bp, Artificial Sequence
  VH1-46_IGHD6-6*01_IGHJ1*01_S102A_S103P_S104F_H111Y
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggagtatgcgccgttctccgctgaatacttccagtactggggccagggcaccctggtcaccgtctcctcagctagc

SEQ ID NO: 3752 - DNA, 372 bp, Artificial Sequence
  VH1-46_IGHD6-6*01_IGHJ1*01_S102A_S103P_S104Y_H111Y
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggagtatgcgccgtactccgctgaatacttccagtactggggccagggcaccctggtcaccgtctcctcagctagc

SEQ ID NO: 3753 - DNA, 330 bp, Artificial Sequence
  L6_IGKJ1*01_S28P
gaaattgtgttgacacagtctccagccaccctgtctttgtctccaggggaaagagccaccctctcctgcagggccagtcagcctgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgtggacgttcggccaagggaccaaggtggaaatcaaacgtacg

SEQ ID NO: 3754 - DNA, 330 bp, Artificial Sequence
  L6_IGKJ1*01_S30N
gaaattgtgttgacacagtctccagccaccctgtctttgtctccaggggaaagagccaccctctcctgcagggccagtcagagtgttaatagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgtggacgttcggccaagggaccaaggtggaaatcaaacgtacg

SEQ ID NO: 3755 - DNA, 330 bp, Artificial Sequence
  L6_IGKJ1*01_S31K
gaaattgtgttgacacagtctccagccaccctgtctttgtctccaggggaaagagccaccctctcctgcagggccagtcagagtgttagcaagtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgtggacgttcggccaagggaccaaggtggaaatcaaacgtacg

The invention claimed is:

1. A method of generating a combinatorial human antibody library comprising a plurality of antibody or antigen-binding antibody fragment species, comprising:
   a) for each antibody or antigen-binding antibody fragment species in the library, combining a human $V_H$ and a $J_H$ or a human $V_H$, a $D_H$, and a $J_H$ germline segment or portion thereof in frame to generate a nucleic acid molecule encoding a VH chain or a portion thereof, wherein, optionally, the VH chain is modified by replacement or insertion of one amino acid, optionally the replacement or insertion of at least one amino acid into at least one complementarity determining region (CDR) selected from among a CDRH1, CDRH2, CDRH3, wherein the CDR optionally is CDRH3;
   b) for each antibody or antigen-binding antibody fragment species in the library, combining a human $V_\kappa$ and a $J_\kappa$ germline segment or portion thereof, or a human $V_\lambda$ and a $J_\lambda$ germline segment or portion thereof in frame to generate a nucleic acid molecule encoding a VL chain or a portion thereof, wherein, optionally, the VL chain is modified by replacement or insertion of one amino acid, optionally the replacement or insertion of at least one amino acid into at least one complementarity determining region (CDR) selected from among a CDRL1, CDRL2, and CDRL3,
   wherein each nucleic acid molecule of part (a) encoding the VH chain or portion thereof comprises a different combination of $V_H$ and $J_H$ or $V_H$, $D_H$ and $J_H$ germline segments yielding a different nucleic acid sequence encoding the VH chain or portion thereof and/or each nucleic acid molecule of part (b) encoding the VL chain or portion thereof comprises a different combination of $V_\kappa$ and $J_\kappa$ germline segments or $V_\lambda$ and $J_\lambda$ germline segments yielding a different nucleic acid sequence encoding the VL chain; and
   c) expressing nucleic acid molecules of parts (a) and (b) and generating the antibody or antigen-binding antibody fragment species that contain a VL chain and a VH chain or a sufficient portion thereof to form an antigen binding site, thereby generating the combinatorial human antibody library,
   wherein the library comprises at least about 50 or 100 or more different antibody or antigen-binding antibody fragment species in an addressable format, wherein the antibody or antigen-binding antibody fragment species at each address is the same antibody or antigen-binding antibody fragment species and is different from the antibody or antigen-binding antibody fragment species at all other addresses, and wherein the amino acid sequence identity of each antibody or antigen-antibody fragment species is known based on the address of the antibody or antigen-binding antibody fragment species; and optionally further comprising,
   d) purifying the antibody or antigen-binding antibody fragment species, optionally to about 70%, 75%, 80%, 85%, 90%, 91%, 92%, 93%, 94%, 95%, 96%, 97%, 98% or 99% purity.

2. A method according to claim 1, wherein the antibody species are full-length antibody species and the antigen-binding antibody fragment species are Fab fragments.

* * * * *